(12) United States Patent
Sexton et al.

(10) Patent No.: US 8,816,055 B2
(45) Date of Patent: Aug. 26, 2014

(54) PLASMA KALLIKREIN BINDING PROTEINS

(75) Inventors: Daniel J. Sexton, Melrose, MA (US); Malini Viswanathan, Burlington, MA (US)

(73) Assignee: Dyax Corp., Burlington, MA (US)

( * ) Notice: Subject to any disclaimer, the term of this patent is extended or adjusted under 35 U.S.C. 154(b) by 40 days.

(21) Appl. No.: 13/345,170

(22) Filed: Jan. 6, 2012

(65) Prior Publication Data
US 2012/0201756 A1    Aug. 9, 2012

Related U.S. Application Data

(60) Provisional application No. 61/430,442, filed on Jan. 6, 2011.

(51) Int. Cl.
*A61K 39/395* (2006.01)
*C07K 16/40* (2006.01)
*A61K 39/00* (2006.01)

(52) U.S. Cl.
CPC ............ *C07K 16/40* (2013.01); *C07K 2317/34* (2013.01); *C07K 2317/55* (2013.01); *C07K 2317/56* (2013.01); *C07K 2317/92* (2013.01); *C07K 2317/565* (2013.01); *C07K 2317/76* (2013.01); *A61K 2039/505* (2013.01); *C07K 2317/94* (2013.01)
USPC ................................ 530/389.3; 424/158.1

(58) Field of Classification Search
CPC . A61K 2300/00; A61K 38/57; C12Q 1/6886; C12Q 2600/136; G01N 33/6893
See application file for complete search history.

(56) References Cited

U.S. PATENT DOCUMENTS

| | | | |
|---|---|---|---|
| 3,682,776 A | 8/1972 | Grundmann et al. |
| 3,691,016 A | 9/1972 | Patel |
| 3,969,287 A | 7/1976 | Jaworek et al. |
| 4,118,481 A | 10/1978 | Schnabel et al. |
| 4,153,687 A | 5/1979 | Schnabel et al. |
| 4,179,337 A | 12/1979 | Davis et al. |
| 4,195,128 A | 3/1980 | Hildebrand et al. |
| 4,229,537 A | 10/1980 | Hodgins et al. |
| 4,247,642 A | 1/1981 | Hirohara et al. |
| 4,330,440 A | 5/1982 | Ayers et al. |
| 4,377,572 A | 3/1983 | Schwarz et al. |
| 4,399,216 A | 8/1983 | Axel et al. |
| 4,595,674 A | 6/1986 | Tschesche et al. |
| 4,609,725 A | 9/1986 | Brady et al. |
| 4,634,665 A | 1/1987 | Axel et al. |
| 4,657,893 A | 4/1987 | Krantz et al. |
| 4,845,242 A | 7/1989 | Powers et al. |
| 4,881,175 A | 11/1989 | Ladner |
| 4,946,778 A | 8/1990 | Ladner et al. |
| 5,118,668 A | 6/1992 | Auerswald et al. |
| 5,179,017 A | 1/1993 | Axel et al. |
| 5,223,409 A | 6/1993 | Ladner et al. |
| 5,260,203 A | 11/1993 | Ladner et al. |
| 5,372,933 A | 12/1994 | Zamarron et al. |
| 5,407,915 A | 4/1995 | Fritz et al. |
| 5,409,895 A | 4/1995 | Morishita et al. |
| 5,426,224 A | 6/1995 | Lee et al. |
| 5,441,931 A | 8/1995 | Sprecher et al. |
| 5,444,156 A | 8/1995 | Veloso et al. |
| 5,576,294 A | 11/1996 | Norris et al. |
| 5,585,089 A | 12/1996 | Queen et al. |
| 5,635,187 A | 6/1997 | Bathurst et al. |
| 5,677,146 A | 10/1997 | Sprecher et al. |
| 5,693,761 A | 12/1997 | Queen et al. |
| 5,693,762 A | 12/1997 | Queen et al. |
| 5,719,041 A | 2/1998 | Lazarus et al. |
| 5,747,449 A | 5/1998 | Lasters et al. |
| 5,770,568 A | 6/1998 | Auerswald et al. |
| 5,780,265 A | 7/1998 | Dennis et al. |
| 5,786,328 A | 7/1998 | Dennis et al. |
| 5,795,865 A | 8/1998 | Markland et al. |
| 5,795,954 A | 8/1998 | Lazarus et al. |
| 5,800,385 A | 9/1998 | Demopulos et al. |
| 5,834,244 A | 11/1998 | Dennis et al. |
| 5,843,895 A | 12/1998 | Lazarus et al. |
| 5,849,992 A | 12/1998 | Meade et al. |
| 5,863,893 A | 1/1999 | Dennis et al. |
| 5,869,637 A | 2/1999 | Au-Young et al. |
| 5,874,407 A | 2/1999 | Kelley et al. |
| 5,880,256 A | 3/1999 | Dennis et al. |
| 5,951,974 A | 9/1999 | Gilbert et al. |
| 5,962,266 A | 10/1999 | White et al. |
| 5,994,125 A | 11/1999 | Markland et al. |
| 6,004,579 A | 12/1999 | Bathurst et al. |
| 6,010,880 A | 1/2000 | Markland et al. |
| 6,013,763 A | 1/2000 | Braisted et al. |
| 6,057,287 A | 5/2000 | Markland et al. |

(Continued)

FOREIGN PATENT DOCUMENTS

| | | |
|---|---|---|
| AT | 275583 T | 9/2004 |
| CA | 2180950 A1 | 8/1995 |

(Continued)

OTHER PUBLICATIONS

Rudikoff et al. (Proc Natl Acad Sci USA 1982 vol. 79 p. 1979).*
MacCallum et al. J. Mol. Biol. (1996) 262, 732-745.*
Pascalis et al. (The Journal of Immunology (2002) 169, 3076-3084).*
Casset et al. (BBRC 2003, 307:198-205).*
Vajdos et al. (J. Mol. Biol. (2002) 320, 415-428).*
Chen et al. (J. Mol. Bio. (1999) 293, 865-881).*
Wu et al. (J. Mol. Biol. (1999) 294, 151-162).*
Padlan et al. (PNAS 1989, 86:5938-5942).*
Lamminmaki et al. (JBC 2001, 276:36687-36694).*
Uebel,"Die behandlung con kniegelenksarthrosen mit trasylol," Langenbacks Arch. Chir., vol. 325, pp. 356-358 (1969).
Urlaub et al., "Isolation of Chinese hamster cell mutants deficient in dihydrofolate reductase activity", Proc. Natl. Acad. Sci. USA 77:4216-4220 (1980).

(Continued)

*Primary Examiner* — Sharon Wen
(74) *Attorney, Agent, or Firm* — Wolf, Greenfield & Sacks, P.C.

(57) ABSTRACT

Plasma kallikrein binding proteins and methods of using such proteins are described.

7 Claims, 22 Drawing Sheets

(56) References Cited

U.S. PATENT DOCUMENTS

| | | |
|---|---|---|
| 6,071,723 A | 6/2000 | Markland et al. |
| 6,087,473 A | 7/2000 | Conklin et al. |
| 6,090,916 A | 7/2000 | Vlasuk et al. |
| 6,103,499 A | 8/2000 | Markland et al. |
| 6,113,896 A | 9/2000 | Lazarus et al. |
| 6,126,933 A | 10/2000 | Warne et al. |
| 6,159,938 A | 12/2000 | Gyorkos et al. |
| 6,180,607 B1 | 1/2001 | Davies et al. |
| 6,261,279 B1 | 7/2001 | Demopulos et al. |
| 6,306,884 B1 | 10/2001 | Buckman et al. |
| 6,333,402 B1 | 12/2001 | Markland et al. |
| 6,407,213 B1 | 6/2002 | Carter et al. |
| 6,423,498 B1 | 7/2002 | Markland et al. |
| 6,472,195 B2 | 10/2002 | Hillman et al. |
| 6,953,674 B2 | 10/2005 | Markland et al. |
| 6,989,369 B2 | 1/2006 | Ladner et al. |
| 7,064,107 B2 | 6/2006 | Ladner et al. |
| 7,067,144 B2 | 6/2006 | Demopulos et al. |
| 7,078,383 B2 | 7/2006 | Ley et al. |
| 7,153,829 B2 | 12/2006 | Ladner et al. |
| 7,166,576 B2 | 1/2007 | Cicardi et al. |
| 7,235,530 B2 | 6/2007 | Blair et al. |
| 7,276,480 B1 | 10/2007 | Ladner et al. |
| 7,550,427 B2 | 6/2009 | Ley et al. |
| 7,628,983 B2 | 12/2009 | Markland et al. |
| 7,704,949 B2 | 4/2010 | Ladner et al. |
| 7,718,617 B2 | 5/2010 | Cicardi et al. |
| 7,811,991 B2 | 10/2010 | Ladner et al. |
| 7,919,462 B2 | 4/2011 | Markland et al. |
| 2001/0027180 A1 | 10/2001 | Isaacs |
| 2003/0096733 A1 | 5/2003 | Ny et al. |
| 2003/0113726 A1 | 6/2003 | Tsuchihashi et al. |
| 2004/0038893 A1 | 2/2004 | Ladner et al. |
| 2004/0053206 A1 | 3/2004 | Cicardi et al. |
| 2004/0171794 A1 | 9/2004 | Ladner et al. |
| 2004/0180827 A1 | 9/2004 | Chen et al. |
| 2005/0075665 A1 | 4/2005 | Golz et al. |
| 2005/0089515 A1 | 4/2005 | Ley et al. |
| 2005/0164928 A1 | 7/2005 | Ladner et al. |
| 2006/0069020 A1 | 3/2006 | Blair et al. |
| 2006/0264603 A1 | 11/2006 | Markland et al. |
| 2007/0049522 A1 | 3/2007 | Ladner et al. |
| 2007/0079096 A1 | 4/2007 | Ladner |
| 2007/0117752 A1 | 5/2007 | Larsen et al. |
| 2007/0213275 A1 | 9/2007 | Clark et al. |
| 2007/0249807 A1 | 10/2007 | Ladner et al. |
| 2007/0253949 A1 | 11/2007 | Golz et al. |
| 2008/0038276 A1 | 2/2008 | Sinha et al. |
| 2008/0038748 A1 | 2/2008 | Kojima et al. |
| 2008/0050716 A1 | 2/2008 | Cicardi et al. |
| 2008/0064637 A1 | 3/2008 | Ladner et al. |
| 2008/0076712 A1 | 3/2008 | Ladner et al. |
| 2008/0131426 A1 | 6/2008 | Ladner et al. |
| 2008/0139473 A1 | 6/2008 | Ladner et al. |
| 2008/0152656 A1 | 6/2008 | Ladner et al. |
| 2008/0188409 A1 | 8/2008 | Blair et al. |
| 2008/0200646 A1 | 8/2008 | Ladner et al. |
| 2008/0221031 A1 | 9/2008 | Blair et al. |
| 2008/0226655 A1 | 9/2008 | Ladner et al. |
| 2008/0260752 A1 | 10/2008 | Ladner et al. |
| 2008/0299050 A1 | 12/2008 | Bortz et al. |
| 2009/0062195 A1 | 3/2009 | Ladner et al. |
| 2009/0075887 A1 | 3/2009 | McPherson |
| 2009/0082267 A1 | 3/2009 | Ladner et al. |
| 2009/0105142 A1 | 4/2009 | Moscicki |
| 2009/0117130 A1 | 5/2009 | Ladner et al. |
| 2009/0123475 A9 | 5/2009 | Siegel |
| 2009/0215119 A1 | 8/2009 | Ladner |
| 2009/0221480 A1 | 9/2009 | Blair et al. |
| 2009/0227495 A1 | 9/2009 | Blair et al. |
| 2009/0233852 A1 | 9/2009 | Blair et al. |
| 2009/0234009 A1 | 9/2009 | Blair et al. |
| 2009/0247452 A1 | 10/2009 | Ellis et al. |
| 2009/0264350 A1 | 10/2009 | Blair et al. |
| 2010/0034805 A1 | 2/2010 | Ladner et al. |
| 2010/0183625 A1 | 7/2010 | Sternlicht |
| 2011/0086801 A1 | 4/2011 | Ladner et al. |

FOREIGN PATENT DOCUMENTS

| | | |
|---|---|---|
| DE | 69533472 T2 | 1/2006 |
| EP | 0132732 A2 | 2/1985 |
| EP | 0255011 A2 | 2/1988 |
| EP | 0285123 A2 | 10/1988 |
| EP | 0307592 A2 | 3/1989 |
| EP | 0401508 A2 | 12/1990 |
| EP | 0486001 A1 | 5/1992 |
| EP | 0621870 B1 | 11/1994 |
| EP | 0621871 B1 | 11/1994 |
| EP | 739355 B1 | 10/1996 |
| EP | 1 288 305 A2 | 3/2003 |
| EP | 1484339 A2 | 12/2004 |
| EP | 12732149 | 3/2014 |
| JP | 7-504891 T | 6/1995 |
| JP | 9-511131 T | 11/1997 |
| JP | 2002-524076 T | 8/2002 |
| WO | 89/10374 A1 | 11/1989 |
| WO | 9002809 A1 | 3/1990 |
| WO | 92/06111 A1 | 4/1992 |
| WO | 93/09233 A2 | 5/1993 |
| WO | 93/14120 A1 | 7/1993 |
| WO | 93/14121 A1 | 7/1993 |
| WO | 93/14122 A1 | 7/1993 |
| WO | 95/18830 A2 | 7/1995 |
| WO | 95/21601 A2 | 8/1995 |
| WO | 96/35788 A2 | 11/1996 |
| WO | 98/52976 A1 | 11/1998 |
| WO | 9963090 A2 | 12/1999 |
| WO | 00/14235 A1 | 3/2000 |
| WO | 00/34317 A2 | 6/2000 |
| WO | 0114424 A2 | 3/2001 |
| WO | 0179480 A1 | 10/2001 |
| WO | 03066824 A2 | 8/2003 |
| WO | 03/103475 A2 | 12/2003 |
| WO | 2004/019968 A1 | 3/2004 |
| WO | 2004/062646 A1 | 7/2004 |
| WO | 2004/062689 A1 | 7/2004 |
| WO | 2005/021557 A2 | 3/2005 |
| WO | 2005/075665 A2 | 8/2005 |
| WO | 2006/066878 A1 | 6/2006 |
| WO | 2006/089005 A2 | 8/2006 |
| WO | 2007079096 A2 | 7/2007 |
| WO | 2009/026334 A2 | 2/2009 |
| WO | 2009026539 A1 | 2/2009 |
| WO | 2009/102927 A1 | 8/2009 |

OTHER PUBLICATIONS

Van Der Logt et al., "Intron-Exon Organization of the Human Gene Coding for the Lipoprotein-associated Coagulation Inhibitor: The Factor Xa Dependent of Inhibitor of the Extrinsic Pathway of Coagulation," Biochemistry, 30:1571-1577 (1991).

Van Dijl et al., "Signal Peptidase 1 of Bacillus subtillis: Patterns of Conserved Amino Acids in Prokaryotic and Eukaryotic Type 1 Signal Peptidases," The EMBO Journal, 11:2819-2828 (1992).

Varadi et al., "Location of Plasminogen-Binding Sites in Human Fibrin(ogen)," Biochemistry, 22:2440-2446 (1983).

Varadi, et al., Segment of Fibrinogen Is in a Region Essential for Plasminogen Binding by Fibrin Fragment E, Biochemistry, 23:2108-2112 (1984).

Vedvick, et al., "High-Level Secretion of Biologically Active Aprotinin from the Yeast Pichia pastoris," J. Ind. Microbiol., 7:197-201 (1991).

Vidal et al., "Making sense of antisense," European Journal of Cancer, 2005, vol. 41, pp. 2812-2818.

Viswanathan M. et al., "Engineered protein protease inhibitors", Current Enzyme Inhibition, Jan. 1, 2009, pp. 87-98, vol. 5, No. 2, Betham Science Publishers Ltd., Hilversum, NL.

Wade, et al., "Solid-Phase Synthesis of ?-Human Atrial Natriuretic Factor: Comparison of the Boc-Polystyrene and Fmoc-Polyamide Methods," Biopolymers, 25: S21-S37 (1986).

(56) References Cited

OTHER PUBLICATIONS

Wagner et al., High Level Expression, Purification, and Characterization of the Kunitz-Type Protease Domain of Protease Nexin-2/Amyloid ?-Protein Precursor, Biochemical and Biophysical Research Communications, 186: 1138-1145 (1992).
Wang et al., "Monitoring of heparin-induced anticoagulation with kaolin-activated clotting time in cadiac surgical patients treated with aprotinin," Anesthesiology, vol. 77, pp. 1080-1084 (1992).
Ward et al. "Binding activities of a repertoire of single immunoglobulin variable domains secreted from *Escherichia coli*" (1989) Nature 341:544-546.
Watson, et al., "Induction of reproducible brain infarction by photochemically initiated thrombosis" Ann Neurol17: 497-504 (1985).
Wei, et. al., "Production and characterization of ectoine by *Marinococcus* sp. ECT1 isolated from a high-salinity environment." J Biosci Bioeng. Mar. 2011;111(3):336-42. Epub Dec. 15, 2010.
Wells, "Additivity of Mutational Effects in Proteins", Biochemistry, vol. 29 (37), pp. 8509-8517 (1990).
Wendel et al., Lower Cardiac Troponin T Levels in Patients Undergoing Cardiopulmonary Bypass and Receiving High-Dose Aprotinin Therapy Indicate Reduction of Perioperative Myocardial Damage; Journal of Thoracic Cardiovascular Surgery, vol. 109, No. 6, pp. 1164-1172 (1995).
Williams et al. "Collagen-induced arthritis as a model for rheumatoid arthritis" Methods Mol Med. 98:207-16 (2004).
Wilson et al., "An animal model of chronic inflammatory pain: pharmacological and temporal differentiation from acute models" Eur J Pain. 10(6):537-49 (2006).
Wilson, et al., "The Calculation and Synthesis of a Template Molecule," Tetrahedron, 49:3655-3663 (1993).
Wood, "Hemostatic Drugs" New England Journal of Medicine, Drug Therapy, 339(4):245-253 (1998).
Worthy et al., "Current status review kallikreins and kinins: mediators in inflammatory joint disease," Int. J. Exp, 1990.
Worthy, K. et al., "Kallikreins and Kinins: Mediators in Inflammatory Joint Disease?", International Review of Experimental Pathology, pp. 587-601, vol. 71, No. 4, Blackwell Scientific, Oxford GB (Aug. 1, 1990).
Written Opinion for PCT/US11/20377 dated Jun. 28, 2011.
Written Opinion from International Application No. PCT/US2008/074061 mailed Dec. 29, 2008.
Wun et al., "Cloning and Characterization of a cDNA Coding for the Lipoprotein-associated Coagulation Inhibitor Shows that it Consists of Three Tandem Kunitz-type Inhibitory Domains," J. Biol. Chem. 263:6001-6004 (1988).
XP_376532.2 (GI:51465288): "Predicted: KIAA0408", GenBank Record created on Aug. 19, 2004, GenBank [online] Bethesda, MD USA: United States National Library of Medicine, retrieved from internet using <URL:http://www.ncbi.nlm.nih.gov/protein/XP_376532.2?report=genpept> GenBank Accession No. XP_376532.2 (GI:51465288).
Zuraw B.L. et al., "Clinical practice. Hereditary angioedema" N Engl J Med 359, 1027-1036, (2008).
Abdel-Salam, et. al., "Expression of mouse anticreatine kinase (MAK33) monoclonal antibody in the yeast *Hansenula polymorpha*", Appl. Microbiol. Biotechnol, vol. 56, p. 157-164 (2001).
Adams et al: "The role of viscosupplementation with hylan G-F 20 (Synvisc(R)) in the treatment of osteoarthritis of the knee: a Canadian multicenter trial comparing hylan G-F 20 alone, hylan G-F 20 with non-steroidal anti-inflammatory drugs (NSAIDs) and NSAIDs alone", Osteoarthritis and Cartilage, Bailliere Tindall, London, GB, vol. 3, No. 4, pp. 213-225, (Dec. 1, 1995).
Adelman, et al., Proteolysis of Platelet Glycoprotein Ib by Plasmin Is Facilitated by Plasmin Lysine-Binding Regions, Blood, vol. 68 (6): 1280-1284, (Dec. 1986).
Alberto Migliore et al: "Open pilot study of ultrasound-guided intra-articular injection of hylan G-F 20 (Synvisc) in the treatment of symptomatic hip osteoarthritis", Clinical Rheumatology; Journal of the International League of Associations for Rheumatology, Springer-Verlag, LO, vol. 24, No. 3, pp. 285-289 (Jun. 1, 2005).
Albrecht, et al., Kunitz-Type Proteinase Inhibitors Derived by Limited Proteolysis of the Inter-?-Trypsin Inhibitors From several Mammalian Sera, Hoppe-Seyler's Z. Physiol. Chem., vol. 364: 1703-1708, (Dec. 1983).
Albrecht, et al.., Elastase Inhibition by the Inter-?-Trypsin Inhibitor and Derived Inhibitors of Man and Cattle, Hoppe-Seyler's Z. Physiol. Chem., vol. 364: 1697-1702, (Dec. 1983).
Altschul et al. "Gapped BLAST and PSI-BLAST: a new generation of protein database search programs." (1997) Nucleic Acids Res. 25:3389-3402.
Anba, et al., Improving the Stability of a Foreign Protein in the Periplasmic Space of *Escherichia coli*, Biochimie, vol. 70(6): 727-733, (1988).
Angliker, et al., The Synthesis of Lysylflouromethanes and their Properties as Inhibitors of Trypsin, Plasmin and Cathepsin B, Biochemistry, 241:871-875, (1987).
Asano M. et al., "Effects of a nonpeptide bradykinin B2 receptor antagonist, FR167344, on different in vivo animal models of inflammation", Br J Pharmacol, vol. 122, p. 1436-1440 (1997).Asano M. et al., Br J Pharmacol, vol. 122, p. 1436-1440 (1997).
Atherton, et al., Peptide Synthesis. Part 2. Procedures for Solid Phase Synthesis using N?-Fluorenylmethycarbonylamino-acids on Polyamide Supports. Synthesis of Substance P and of Acyl Carrier Protein 65-74 Decapeptide, J. Chem. Soc. Perkins Trans, 1:538-546, (1981).
Attwood, The Babel of Bioinformatics; Science, vol. 290, pp. 471-473 (2000).
Auerswald et al., Expression, Isolation and Characterization of Recombinant [Arg15, Glu52] Aprotinin, Bio. Chem. Hoppe-Seyler, 369:(Suppl)27-35 (1988).
Baba, M et al., States of Tyrosyl Residues and Circular Dichroism of Kunitz Trypsin Inhibitor, J. Biochem 65 (1):113-121 (1969).
Balduyck, et al., Human Urinary Proteinase Inhibitor: Inhibitory Properties and Interaction with Bovine Trypsin, Bio. Chem. Hoppe-Seyler, vol. 366: 9-14, (1985).
Baneyx et al., Construction and Characterization of *Escherichia coli* Strains Deficient in Multiple Secreted Proteases: Protease III Degrades High-Molecular-Weight Substrates In Vivo, J Bacteriol., 173:2696-2703 (1991).
Baneyx et al., "In Vivo Degradation of Secreted Fusion Proteins by the *Escherichia coli* Outer Membrane Protease OmpT", J. Bacteriol., 172:491-494, (1990).
Baumann., "A multi-level study of recombinant *Pichia pastoris* in different oxygen conditions", BMC Syst Biol. 4:141 (Oct. 22, 2010).
Bayes et al., "Gateways to Clinical Trials" Methods Find Exp. Clin. Pharmacol., vol. 28(3): pp. 185-206 (2006).
Beckmann et al., "Preparation of chemically 'mutated' aprotinin homologues by semisynthesis-P1 substitutions change inhibitory specificity," Eur. J. Biochem., vol. 176, pp. 675-682 (1988).
Beech et al., "Further characterisation of a thromboembolic model of stroke in the rat" Brain Res, vol. 895, p. 18-24 (2001).
Berge, S.M., et al., "Pharmaceutical salts", J. Pharm. Sci. 66:1-19 (1977).
Bergthorsdottir et al., "Signals that initiate somatic hypermutation of B cell in vitro", J. Immunol., p. 166:2228 (2001).
Berndt, et al.,"Designed Replacement of an Internal Hydration Water Molecule in BPTI: Structural and Functional Implications of a Glycine-to-Serine Mutation," Biochemistry, 32: 4564-4570 (1993).
Bhoola et al., "Bioregulation of Kinins: Kallikreins, Kininogens and Kininases," Pharmacological Reviews, 44 :1-80 (1992).
Bird et al. "Single chain antigen binding proteins", Science 242:423-426 (1988).
Blaber et al., "Targeting kallikrein 6-proteolysis attenuates CNS inflammatory disease," The FASEB Journal, express article published online Mar. 19, 2004.
Bodanszky et al., The Practice of Peptide Synthesis (Springer-Verlag, New York, 1984).
Bork, "Powers and pitfalls in sequence analysis: the 70% hurdle," Genome Research, vol. 10, pp. 398-400 (2000).

(56) References Cited

OTHER PUBLICATIONS

Bowdish K, et. al., "Yeast expression of a catalytic antibody with chorismate mutase activity.", J Biol Chem.; 266 (18):11901-8 (Jun. 25, 1991).
Bowie et al. "Deciphering the message in protein sequences: tolerance to amino acid substitutions." Science 247:1306-1310 (1990).
Brenner, "Errors in genome annotation," Trends in Genetics, vol. 15, No. 4, pp. 132-133 (1999).
Brinkmann et al., "Design of an aprotinin variant with inhibitory activity against chymotrypsin and cathepsin G by recombinant DNA technology," Biol. Chem. Hoppe-Seyler, vol. 371, pp. 43-52 (1990).
Browne et al., "Expression of Recombinant Human Plasminogen and Aglycoplasminogen in HeLa Cells," Genebank, Accession No. M74220 (1991).
Broze et al., "Regulation of Coagulation by a Multivalent Kunitz-Type Inhibitor," Biochemistry, 29:7539-7546, (1990).
Brus et al., "Disease Severity Is Correlated with Plasma Clotting and Fibrinolytic and Kinin-Kallikrein Activity in Neonatal Respiratory Distress Syndrome," Pediatric Research, 41:120-127, (1997).
Buchan et al., "A new model of temporary focal neocortical ischemia in the rat", Stroke 23 (2): 273-9 (1992).
Budavari, ed., Merck index, 11th ed., ISBN 911910-28-X, entries 923, 1745, 2740, 7425, (1989).
Buras et al., "Animal models of sepsis: setting the stage", Nat Rev Drug Discov. 4(10):854-65 (2005).
Burton et al. "Human Antibody Effector Function", Adv. Immunol. 51:1-84 (1992).
Carey et al., Advanced Organic Chemistry, 3rd Edition, Part B: Reactions and Synthesis, Plenum Press, New York: 678-686 (1990).
Carmichael, "Rodent models of focal stroke: size, mechanism, and purpose", NeuroRx 2: 396-409 (2005).
Carpenter et al., "Rational design of stable lyophilized protein formulations: theory and practice," Parmaceutical Biotechnology, vol. 13, pp. 109-133 (2002).
Casati et al., "Cardiopulmonary support and physiology—tranexamic acid compared with high-dose aprotinin in primary elective heart operations: effects on perioperative bleeding and allogeneic transfusions," The Journal of Thoracic and Cardiovascular Surgery, vol. 120, pp. 520-527 (2000).
Cernak, "Animal models of head trauma", NeuroRx. 2(3): 410-422 (2005).
Chen et al., "A model of focal ischemic stroke in the rat: reproducible extensive cortical infarction", Stroke 17 (4): 738-43 (1986).
Chen et al., "Establishment of an animal model of oral mucositis induced by conditioning regimen of haematopoietic stem cell transplantation" Zhonghua Kou Qiang Yi Xue Za Zhi. 42(11):672-6 (2007). (Abstract only).
Chen et al., "Refined 2-5 A X-ray Crystal Structure of the Complex Formed by Porcine Kallikrein A and the Bovine Pancreatic Trypsin Inhibitor—Crystallization, Patterson Search, Structure Determination, Refinement, Structure and Comparison with its Components and with the Bovine Trypsin-Pancreatic Trypsin Inhibitor Complex" J. Mol. Biol., 164:283-311 (1983).
Chen et al., Solution Structure of a Kunitz-type Chymotrypsin Inhibitor Isolated from the Elapid Snake Bungarus Fasciatus, J. Biological Chemistry 276:45079-45087 (2001).
Chouthia et al. "Canonical structures for the hypervariable regions of immunoglobulins." (1987) J. Mol. Biol. 196:901-917 (1987).
Sainz I.M. et al., "Fifty years of research on the plasma kallikrein-kinin system: from protein structure and function to cell biology and in-vivo pathophysiology" Thromb Haemost 98, 77-83, 2007.
Sartor, R.B., et al., "Selective Kallikrein-Kinin System Activation in Inbred Rats Differentially Susceptible to Granulomatous Enterocolitis," Gastroenterology, 110:1467-1481 (1996).
Scatchard, George, The Attractions of Proteins for Small Molecules and Ions, Ann. NY Acad. Sci, 51:660-672 (1949).
Schaffirzel et al. "Ribosome display: an in vitro method for selection and evolution of antibodies from libraries" J Immunol Methods. 231(1-2):119-35 (1999).

Schechter et al, On the Active Site of Proteases, III Mapping the Active Site of Papain; Specific Peptide Inhibitors of Papain, Biochemical and Biophysical Research Communications 32(5):898-902 (1968).
Schechter et al., On the Size of the Active Site on Proteases, I Papain, Biochemical and Biophysical Research Communications 27(2):157-162 (1967).
Schmaier A.H."Assembly, activation, and physiologic influence of the plasma kallikrein/kinin system" (2008) Int Immunopharmaco18, 161-165.
Schmaier et al., Hemostasis and Thrombosis, Chapter 2, 2nd Edition, Basic Principals and Clinical Practice: 18-38 (1987).
Schmid-Elsaesser, et al., "A critical reevaluation of the intraluminal thread model of focal cerebral ischemia: evidence of inadvertent premature reperfusion and subarachnoid hemorrhage in rats by laser-Doppler flowmetry" Stroke 29 (10): 2162-70 (1989).
Schmidt et al., "A male accessory gland peptide with protease inhibitory activity in *Drosophila funebris*," Swiss-Prot, Accession #P11424 (1992).
Schnabel et al., Aprotinin: Preparation by Partial Desulphurization of Aprotinin by Means of Raney Nickel and Comparison with Other Aprotinin Derivatives, Biol. Chem. Hoppe-Seyler, 367:1167-1176 (1986).
Schofield, et. al., "Monoclonal antibodies that neutralize HEV recognize an antigenic site at the carboxyterminus of an ORF2 protein vaccine" Vaccine (2003) 22(2):257-67.
Schoonooghe, et. al., "Efficient production of human bivalent and trivalent anti-MUC1 Fab-scFv antibodies in *Pichia pastoris*", BMC Biotechnol. Aug. 11, 2009;9:70.
Schopf, "IDEC-114 (IDEC)" Curr Opin Investig Drugs, 2(5):635-8 (2001). (Abstact only).
Schultz et al. "SMART, a simple modular architecture research tool: identification of signaling domains" (1998) Proc. Natl. Acad. Sci. USA 95:5857.
Schultz et al. "SMART: a web-based tool for the study of genetically mobile domains" (2000) Nucl. Acids Res 28:231.
Schwartz et al., "Stability studies on derivatives of the bovine trypsin inhibitor," Biochemistry, vol. 26, pp. 3544-3551 (1987).
Sekiguchi et al., "Experimental spinal stenosis: relationship between degree of cauda equina compression, neuropathology, and pain" Spine 29, 1105-1111 (2004)).
Sharma, et al. "The kinin antagonist hoe 140 reduces acute paw oedema in rats caused by carrageenan, bradykinin and kaolin" lnflammopharmacology 6,9-17 (1998).
Sheppard, et al., Acid-Labile Resin Linkage Agents for Use in Solid Phase Peptide Synthesis, Int. J. Peptide Protein Res., 20:451-454 (1982).
Sheridan, et al., A Multicenter Trial of the Use of the Proteolytic Enzyme Inhibitor Aprotinin in Colorectal Surgery, Dis. Colon Rectum, 32:505-508 (1989).
Shibuya, et. al., "Primary Structure of Guinea Pig Plasma Prekallikrein", Immunopharmacology, vol. 45 (1-3), p. 127-134, Abstract p. 131, Fig 1, 2 (1999).
Siebeck et al., "Inhibition of plasma kallikrein with aprotinin in porcine endotoxin shock," J. Trauma, vol. 34, pp. 193-198 (1993).
Silverberg et al. "The Contact System and Its Disorders," in Blood: Principles and Practice of Hematology, Handin R. et al., eds. J B. Lippincott Co., Philadelphia, (1995).
Singer and McClain, "A porcine burn model" Methods Mol Med. 78: 107-19 (2003).
Skolnick et al., "From genes to protein structure and function: novel applications of computational apporaches in the genomic era," Trends in Biotech., 2000, vol. 18, No. 1, pp. 34-39.
Slootstra et al. "Structural aspects of antibody-antigen interaction revealed through small random peptide libraries", Molecular Diversity,1, 87-96 (1996).
Smith, "Filamentous fusion phage: novel expression vectors that display cloned antigens on the virion surface" Science 228:1315-1317 (1985).
Smith, BJ. et al. "Prolonged in vivo residence times of antibody fragments associated with albumin" Bioconjug Chem 12(5):750-756 (2001).

(56) References Cited

OTHER PUBLICATIONS

SonHammer et al. "Pfam: a comprehensive database of protein domain families based on seed alignments" (1997) Proteins 28(3):405-420.
Sonis et al. "An animal model for mucositis induced by cancer chemotherapy" (1990) Oral Surg Oral Med Oral Pathol. 69:437-43.
Sonis et al. "Validation of a new scoring system for the assessment of clinical trial research of oral mucositis induced by radiation or chemotherapy. Mucositis Study Group." (1999) Cancer 85:2103-13.
Sprecher et al., "Molecular Cloning, Expression, and Partial Characterization of a Second Human Tissue-Factor-Pathway Inhibitor," Proc. Natl. Acad. Sci. USA, 91:3353-3357 (1994).
Stadnicki et al., "Activation of the contact system and circulating neutrophil elastase in ulcerative colitis patients" 10th World Congress of Gastroenterology, p. 1166, 1994.
Stadnicki et al., "Activation of the Kallikrein-Kinin System in Indomethacin-Induced Enterocolitis in Genetically Suseprible Rats," J. Invest. Med., 44:299A (1996).
Stadnicki et al., "Selective Plasma Kallikrein Inhibitor Attenuates Acute Intestinal Inflammation in Lewis Rat," Dig. Dis. Sci., 41:912-920 (1996).
Stevenson et al., "A mouse model of burn wounding and sepsis" Methods Mol Med. 78:95-105 (2003).
Stewart et al., Solid-Phase Peptide Synthesis (W.H. Freeman Co., San Francisco 1989.
Stultz, et al. "Structural analysis based on state-space modeling." Protein Sci. 2:305-314 (1993).
Sunkureddi et al., "Clinical signs of gout," Hospital Physician, 2006, pp. 39-41.
Supplemental European Search Report from corresponding EP Application No. 07758271.6 dated Jun. 24, 2010.
Takahashi, et al., "Production of humanized Fab fragment against human high affinity IgE receptor in *Pichia pastoris*" Biosci Biotechnol Biochem 64(10):2138-44 (2000).
Tamura, et al., "Focal cerebral ischaemia in the rat: 1. Description of technique and early neuropathological consequences following middle cerebral artery occlusion" J Cereb Blood Flow Metab 1: 53-60 (1981).
Tanaka et al. "A novel rat model of abdominal aortic aneurysm using a combination of intraluminal elastase infusion and extraluminal calcium chloride exposure" J Vasc Surg. 50(6):1423-32 (2009).
The Merck Index: 145, 263, 427, 428, 1183, and 1184 (1989).
Tian et al., "Synthesis of Optically Pure C?-methyl-arginine," Int. J. Peptide Res., 40:119-126 (1992).
Timmerman et al., "Functional reconstruction and synthetic mimicry of a conformational epitope using CLIPS TM technology" J. Mol. Recognit. 20:283-99 (2007).
Tomlinson et al. "Structural repertoire of the human Vk domain" EMBO J. 14(18):4628-3 (1995).
Tomlinson, et al. "The repertoire of human germline VH sequences reveals about 50 groups of VH segments with different hypervariable loops" J. Mol. Biol. 227:776-798 (1992).
Tschesche et al., "Semisynthetic engineering of proteinase inhibitor homologues," Biochim. Biophys. Acta, vol. 913, pp. 97-101 (1987).
Chouthia et al. "Structural Repertoire of the Human VH Segments", J. Mol. Biol. 227:799-817 (1992).
Chung et al., "Human plasma prekallikrein, a zumogen to a serine protease that contains four tandem repeats," GenBank, Accession #P03952 (1986).
Colman et al., Hemostasis and Thrombosis Basic Principles and Clinical Practice, Chapter 1, 2nd Edition, 3-17 (1987).
Colman et al., "The Plasma Kallikrein-Kinin System in Sepsis, Inflammatory Arthritis, and Enterocolitis" Clinical Reviews in Allergy and Immunology, Vol. 16, pp. 365-384 (1998).
Colman R. W., "Plasma and tissue Kallikrein in Arthritis and Inflammatory Bowel Disease", Immunopharmacology, Jan. 1, 1999, pp. 103-108, vol. 43, No. 2/03, Elsevier Science Publishers, BV.
Colman RW et al., "Activation of the kallikrein-kinin system in arthritis and enterocolitis in genetically susceptible rats: modulation by a selective plasma kallikrein inhibitor", Proceedings of the Association of American Physicians, Jan. 1, 1997, pp. 10-22, vol. 109, No. 1, Cambridge, MA US.
Colman, et al., "Contact System: A Vascular Biology Modulator With Anticoagulant, Profibrinolytic, Antiadhesive, and Proinflammatory Attributes" Blood, 90, 3819-3843 (1997).
Communication received in EP Patent Application 03757339.1, dated Apr. 23, 2008.
Communication received in EP Patent Application 03791557.6, dated Nov. 27, 2008.
Communication received in EP Patent No. 1 484 339, dated Sep. 29, 2005.
Cook et al. (1995) Immunol. Today 16(5):237-242.
Corpet, et al. "Recent improvements of the ProDom database of protein domain families" Nucl. Acids Res. 27:263-267 (1999).
Cumming et al., "Hemodynamic, Renal, and Hormonal Aprotinin in an Ovine Model of Septic Shock," Critical Care Medicine, 20:1134-1139 (1992).
Current Protocols in Molecular Biology, John Wiley & Sons, N.Y. (1989) 6.3.1-6.3.6.
Currie et al., "Design and Synthesis of a Bicyclic Non-Peptide ?-Bend Mimetic of Enkephalin," Tetrahedron, 49:3489-3500 (1993).
De Campos, et al., "Antioedematogenic and antinociceptive actions of NPC 18521, a novel bradykinin B2 receptor antagonist", Eur J Pharmacol316, 277-286 (1996).
De Haard, et al. "A large non-immunized human Fab fragment phage library that permits rapid isolation and kinetic analysis of high affinity antibodies". J. Biol. Chem 274:18218-30, (1999).
De Wildt, et al., "Characterization of human variable domain antibody fragments against the U1 RNA-associated A protein, selected from a synthetic and patient-derived combinatorial V gene library" Eur J Immunol. 26(3):629-39 (1996).
De Wildt, et al. "Antibody arrays for high-throughput screening of antibody-antigen interactions", Nat. Biotechnol. 18:989-994 (2000).
Dela Cadena et al., "Role of Kallikrein-Kinin System in the Pathogenesis of Bacterial Cell Wall-Induced Inflammation and Enterocolitis," Transact. Assoc. Am. Physicians, 105:229-237 (1992).
Dela Cadena, et al., "Inhibition of Plasma Kallikrein Prevents Peptidoglycan-Induced Arthritis in the Lewis Rat," FASEB Journal, 9:446-452 (1995).
Deng, et. al., "Production of recombinant humanized anti-HBsAg Fab antibody by fermentation" Sheng Wu Gong Cheng Xue Bao, 20(5):800-4 (Sep. 2004) (Abstact Only).
Dennis & Lazarus, "Kunitz Domain Inhibitors of Tissue Factor-Factor VIIa (I. Potent Inhibitors Selected from Libraries by Phage Display)," Journal of Biological Chemistry 269:22129-22136 (1994).
Dennis et al., "Potent and Selective Kunitz Domain Inhibitors of Plasma Kallikrein Designed by Phage Display," J. Biol. Chem., 270:25411-25417 (1995).
Diaz et al., "The Design of Water Soluble ?-Sheet Structure Based on a Nucleation Strategy," Tetrahedron, 49:3533-3545 (1993).
Dimaio et al., "A New Class of Potent Thrombin Inhibitors That Incorporates a Scissile Pseudopeptide Bond," FEBS Lett, 282(1):47-52 (1991).
Dittmar et al., "External carotid artery territory ischemia impairs outcome in the endovascular filament model of middle cerebral artery occlusion in rats" Stroke 34: 2252-7 (2003).
Dittmar et al., "Fischer-344 rats are unsuitable for the MCAO filament model due to their cerebrovascular anatomy" J Neurosci Methods 156: 50 (2006).
Doerks et al., "Protein annotation: detective work for function prediction," Trends in Genetics, vol. 14, No. 6, pp. 248-250 (1998).
Dragosits, et. al., "The effect of temperature on the proteome of recombinant *Pichia pastoris*", J Proteome Res. Mar. 2009;8(3):1380-92.
Dragosits, et. al., "The response to unfolded protein is involved in osmotolerance of *Pichia pastoris*" BMC Genomics. Mar. 26, 2010;11:207.

(56) References Cited

OTHER PUBLICATIONS

Druar, et. al., Analysis of the expressed heavy chain variable-region genes of *Macaca fascicularis* and isolation of monoclonal antibodies specific for the Ebola virus' soluble glycoprotein Immunogenetics, 57(10):730-8 (2005).
Dufton, "Protein inhibitors and dendrotoxins," Eur. J. Biochem., vol. 153, pp. 647-654. (1985).
Edqvist, et al., "Production of functional IgM Fab fragments by *Saccharomyces cerevisiae*", J Biotechnol 20 (3):291-300 (1991).
Eigenbrot et al. "Structural Effects Induced by Removal of a Disulfide-Bridge: The X-ray Structure of the C30A/C51A Mutant of Basic Pancreatic Trypsin Inhibitor at 1.6 A," Protein Engineering, 3:591-598 (1990).
Ellis et al., "The Urokinase Receptor: Involvement in Cell Surface Proteolysis and Cancer Invasion," Ann. NY. Acad. Sci., 667:13-31 (1992).
European Communication from European Application No. 03791557.6, dated Oct. 29, 2007.
European Search Report dated Nov. 2, 2010, from European Application No. 08798517.2.
Extended European Search Report dated Feb. 14, 2012 for European Application No. 0879823.2.
Extended European Search Report dated Apr. 1, 2009 from EP Application No. 08018863.4, which includes the European Search Report and the European Search Opinion.
Extended European Search Report dated Oct. 1, 2010 from European Application Serial No. 10164197.5.
Extended European Search Report for European Application No. 10180486.2 dated Feb. 15, 2011.
Extended European Search Report for PCT/US2008/074061 dated Nov. 2, 2010.
Extended European Search Report from European Application No. 10180484.7 dated Mar. 9, 2011.
Extended European Search Report from European Application No. 07758271.6 dated Jun. 24, 2010.
Extended European Search Report from European Application Serial No. 10180486.2 dated Feb. 23, 2011.
Falquet et al. "The PROSITE database, its status in 2002." (2002) Nucleic Acids Res. 30:235-238.
Fidler & Ellis, "The Implications of Angiogenesis for the Biology and Chemistry of Cancer Metastasis," Cell, 79:185-188 (1994).
Fields & Noble, "Solid Phase Peptide Synthesis Utilizing 9-fluorenylmethocarbonyl Amino Acids," Int. J. Peptide Protein Research, 35:161-214 (1990).
Naess, et al., "Effects of a Combined Drug Regimen on Tumour Necrosis Factor and Plasma Kallikrein Activity in Experimental Endotoxaemia," Eur. J. Surg., 160:77-86 (1994).
Nagai et al., "Synthesis of a Bicyclic Dipeptide with the Shape of ?-Turn Central Part," Tetrahedron Letters, 26 (5):647-650 (1985).
Nagai, et al., Bicyclic Turned Dipeptide (BTD) as a ?-Turn Mimetic; its Design, Synthesis, and Incorporation into Bioactive Peptides, Tetrahedron, 49:3577-3592 (1993).
Needleman et al. "A general method applicable to the search for similarities in the amino acid sequences of two proteins" (1970) J. Mol. Biol. 48:444-453.
Neuhaus, et al., "Effect of Aprotinin on Intraoperative Bleeding and Fibrinolysis in Liver Transplantation," Lancet, 2: 924-925 (1989).
Ngo et al., "The protein folding problem and tertiary structure prediction, Chapter 14: Computational complexity protein structure prediction, and the Levinthal paradox," pp. 433-440 and 492-495 only (1994).
Ngo, et al., "Computational Complexity, Protein Structure Prediction, and the Levinthal Paradox", The Protein Folding Problem and Tertiary Structure Prediction, Chapter 14, pp. 433-440 and 492-495 only (1994).
Ning, et. al., "Production of recombinant humanized anti-HBsAg Fab fragment from *Pichia pastoris* by fermentation.", J Biochem Mol Biol. ;38(3):294-9. (May 31, 2005).
NM_008455.2 (GI: 236465804): "Plasma kallikrein precursor", GenBank Record created on Dec. 29, 2010 GenBank [online] Bethesda, MD USA: United States National Library of Medicine, retrieved from internet using <URL:http://www.ncbi.nlm.nih.gov/nuccore/236465804?sat=14&satkey=4833839> GenBank Accession No. NM_008455.2 (GI: 236465804).
NM_012725.2 (GI:162138904): "Plasma kallikrein precursor", GenBank Record created on Dec. 26, 2010 GenBank [online] Bethesda, MD USA: United States National Library of Medicine, retrieved from internet using <URL:http://www.ncbi.nlm.nih.gov/nuccore/162138904?sat=14&satkey=5346361> GenBank Accession No. NM_012725.2 (GI:162138904).
Novotney et al., "Purification and Characterization of the Lipoprotein-associated Coagulation Inhibitor from Human Plasma," J. Biol. Chem. 264:18832-18837 (1989).
NP_000217.2 (GI:55956899): "keratin, type I cytoskeletal 9 ", GenBank Record created on Dec. 27, 2010 GenBank [online] Bethesda, MD USA: United States National Library of Medicine, retrieved from internet using <URL:http://www.ncbi.nlm.nih.gov/protein/55956899?sat=14&satkey=4890700> GenBank Accession No. NP_000217.2 (GI:55956899).
NP_000418.2 (GI:109255251): "loricrin", GenBank Record created on Nov. 3, 2010 GenBank [online] Bethesda, MD USA: United States National Library of Medicine, retrieved from internet using <URL:http://www.ncbi.nlm.nih.gov/protein/109255251?sat=14 &satkey=6156833> GenBank Accession No. NP_000418.2 (GI:109255251).
NP_000883.2 (GI: 78191798): "Plasma kallikrein preproprotein", GenBank Record created on Nov. 21, 2010, GenBank [online] Bethesda, MD USA: United States National Library of Medicine, retrieved from internet using <URL:http://www.ncbi.nlm.nih.gov/protein/78191798?sat=14&satkey=4530481> GenBank Accession No. NP_000883.2 (GI: 78191798).
NP_000892 (GI: 158508572): "mineralocorticoid receptor isoform 1", GenBank Record created on Dec. 27, 2010,GenBank [online] Bethesda, MD USA: United States National Library of Medicine, retrieved from internet using <URL:http://www.ncbi.nlm.nih.gov/protein/158508572?sat=14&satkey=4536058> GenBank Accession No. NP_000892.2 (GI: 158508572).
NP_005850.1 (GI:5032007): "transcriptional activator protein Pur-alpha", GenBank Record created on Dec. 28, 2010, GenBank [online] Bethesda, MD USA: United States National Library of Medicine, retrieved from internet using <URL:http://www.ncbi.nlm.nih.gov/protein/5032007?sat=14&satkey=4526134> GenBank Accession No. NP_005850.1 (GI:5032007).
NP_006228.3 (GI:110347449): "POU domain, class 4, transcription factor 1", GenBank Record created on Dec. 27, 2010, GenBank [online] Bethesda, MD USA: United States National Library of Medicine, retrieved from internet using <URL:http://www.ncbi.nlm.nih.gov/protein/110347449?sat=14&satkey=4536081> GenBank Accession No. NP_006228.3 (GI:110347449).
NP_009060.2 (GI:22547197): "zinc finger protein ZIC 2", GenBank Record created on Dec. 24, 2010, GenBank [online] Bethesda, MD USA: United States National Library of Medicine, retrieved from internet using <URL:http://www.ncbi.nlm.nih.gov/protein/22547197?sat=14&satkey=4290853> GenBank Accession No. NP_009060.2 (GI:22547197).
NP_031393.2 (GI:21396480): "RNA-binding protein Raly isoform 2", GenBank Record created on Dec. 25, 2010, GenBank [online] Bethesda, MD USA: United States National Library of Medicine, retrieved from internet using <URL:http://www.ncbi.nlm.nih.gov/protein/21396480?sat=14&satkey=4835374> GenBank Accession No. NP_031393.2 (GI:21396480).
NP_032481.2 (GI: 236465805): "Plasma kallikrein precursor", GenBank Record created on Dec. 29, 2010 GenBank [online] Bethesda, MD USA: United States National Library of Medicine, retrieved from internet using <URL:http://www.ncbi.nlm.nih.gov/protein/236465805?sat=14&satkey=4833839> GenBank Accession No. NP_032481.2 (GI:236465805).
NP_036857.2 (GI:162138905): "Plasma kallikrein precursor", GenBank Record created on Dec. 26, 2010 GenBank [online] Bethesda, MD USA: United States National Library of Medicine, retrieved from internet using <URL:http://www.ncbi.nlm.nih.gov/protein/162138905?sat=14&satkey=5346361> GenBank Accession No. NP_036857.2 (GI:162138905).

(56) References Cited

OTHER PUBLICATIONS

NP_056932.2 (GI:153791670): "Plasma kallikrein preproprotein", GenBank Record created on Dec. 27, 2010, GenBank [online] Bethesda, MD USA: United States National Library of Medicine, retrieved from internet using <URL:http://www.ncbi.nlm.nih.gov/protein/153791670?sat=14&satkey=4553701> GenBank Accession No. NP_056932.2 (GI:153791670).

NP_061856.1 (GI:9506713): "H/ACA ribonucleoprotein complex subunit 1", GenBank Record created on Dec. 24, 2010, GenBank [online] Bethesda, MD USA: United States National Library of Medicine, retrieved from internet using <URL:http://www.ncbi.nlm.nih.gov/protein/9506713?sat=14&satkey=4524138> GenBank Accession No. NP_061856.1 (GI:9506713).

NP_065104.1 (GI:9966841): "cell death regulator Aven", GenBank Record created on Dec. 26, 2010, GenBank [online] Bethesda, MD USA: United States National Library of Medicine, retrieved from internet using <URL:http://www.ncbi.nlm.nih.gov/protein/9966841?sat=14&satkey=4843224> GenBank Accession No. NP_065104.1 (GI:9966841).

NP_115818.2 (GI:53829370): "neuralized-like protein 4 isoform 1", GenBank Record created on Dec. 27, 2010, GenBank [online] Bethesda, MD USA: United States National Library of Medicine, retrieved from internet using <URL:http://www.ncbi.nlm.nih.gov/protein/53829370?sat=14&satkey=4560911> GenBank Accession No. NP_115818.2 (GI:53829370).

NP_476429.2 (GI:109148552): "keratin, type II cytoskeletal 3", GenBank Record created on Dec. 24, 2010 GenBank [online] Bethesda, MD USA: United States National Library of Medicine, retrieved from internet using <URL:http://www.ncbi.nlm.nih.gov/protein/109148552?sat=14&satkey=6358709> GenBank Accession No. NP_NP_476429.2 (GI:109148552).

NP_631961.1 (GI:21327701): "TATA-binding protein-associated factor 2N isoform 1", GenBank Record created on Dec. 25, 2010, GenBank [online] Bethesda, MD USA: United States National Library of Medicine, retrieved from Internet using <URL:http://www.ncbi.nlm.nih.gov/protein/21327701?sat=14&satkey=4528109> GenBank Accession No. NP_631961.1 (GI:21327701).

NP_787059.2 (GI:40068462): "At-rich interactive domain-containing protein 1B isoform 3", GenBank Record created on Mar. 4, 2010, GenBank [online] Bethesda, MD USA: United States National Library of Medicine, retrieved from Internet using <URL:http://www.ncbi.nlm.nih.gov/protein/NP_787059.2?report=genpept> GenBank Accession No. NP_787059.2 (GI:40068462).

Nwariaku, et al., "Effect of a bradykinin antagonist on the local inflammatory response following thermal injury" Burns, 22:324-327 (1996). (Abstract only).

O'Reilly, et al., "Angiostatin: A Novel Angiogenesis Inhibitor That Mediates the Suppression of Metases by a Lewis Lung Carcinoma," Cell, 79 317-328 (1994).

Oi et al. "Chimeric Antibodies" (1986) BioTechniques 4:214.

Okamoto, et al., "A Finding of Highly Selective Synthetic Inhibitor of Plasma Kallikrein; Its Action to Bradykinin Generation, Intrinsic Coagulation and Experimental DIC," Agents Actions Suppl., 38(I):198-205 (1992).

Pan et al., "Reperfusion inury following cerebral ischemia: pathophysiology, MR imaging, and potential therapies," Neuroradiology, 2007, vol. 49, pp. 93-102.

Park, et al "Three Dimensional Structure of the Kringle Sequence: Structure of Prothrombin Fragment 1," Biochemistry, 25:3977-3982 (1986).

PCT International Search Report dated Jul. 21, 2008 and issued in PCT/US05/34335.

PCT Written Opinion dated Jul. 21, 2008 and issued in PCT/US05/34335.

Peng, "Experimental use of murine lupus models" Methods Mol Med. 102:227-72 (2004).

Phillips, "The challenge of gene therapy and DNA dellicery," J. Pharm. Pharmacology, vol. 53, pp. 1169-1174 (2001).

Pirollo et al., "Targeted delivery of small interfering RNA: approaching effective cancer therapies," Cancer Res., 2008, vol. 68, No. 5, pp. 1247-1250.

Pitt et al., "Rabbit monoarticular arthritis as a model for intra-articular drug injections. The local action of administered cortisol and a-1 proteinase inhibitor," Agents and Actions, vol. 15, No. 5-6, abstract online, retrieved from internet <URL:http://www.springerlink.com/content/j82860503948741/p> (Dec. 1984).

Powers et al., "Expression of Single-Chain Fv-Fc Fusions in *Pichia pastoris*", J. Immunol. Methods. 251:123-35 (2001).

Putterman, C., "Aprotinin Therapy in Septic Shock," ACTA Chir. Scand., 155:367 (1989).

Rahman et al., "Identification and functional importance of plasma kallikrein in the synovial fluids of patients with rheumatoid, psoriatic, and osteoarthritis," Annals of the Rheumatic Diseases, vol. 54, pp. 345-350 (1995).

Reginato and Olsen, "Genetics and experimental models of crystal-induced arthritis. Lessons learned from mice and men: is it crystal clear?" Curr Opin Rheumatol. 19(2):134-45 (2007).

Reichert, "Technology evaluation: lumiliximab, Biogen Idec" Curr Opin Mol Ther., 6(6):675-83 (2004). (Abstract only).

Ren, et al., "Inflammatory Models of Pain and Hyperalgesia" Ilar J. 40(3): 111-118 (1999).

Robbins, K.C. et al., Hemostasis and Thrombosis, Chapter 21, 2nd Edition, Basic Principles and Clinical Practice: 340-357 (1987).

Roberts et al., "Directed evolution of a protein: seleciton of potent neurtophil elastase inhibitor displayed on M13 fusion phage," PNAS USA, vol. 89, pp. 2429-2433 (1992).

Roberts et al., "Protease inhibitor display M13 phage: selection of high-affinity neurtophil elastase inhibitors," Gene, vol. 121, pp. 9-15 (1992).

Rossi, E. et al., The Synthetic Peptide DX88 Binds to Endothelial Cells In Vitro and Retains the Inhibitory Activity on Kallikrein, International Immunopharmacology 2(9):1313, Abstract 142 (2002).

Jostock, et. al., "Rapid generation of functional human IgG antibodies derived from Fab-on-phage display libraries" J. Immunol. Methods, 289(1-2):65-80 (2004).

Kabet, et al. Sequences of Proteins of Immunological Interest, Fifth Edition, U.S. Dept. of Health and Human Services, NIH Publication No. 91-3242 (1991).

Kanppik et al., "Fully synthetic human combinatorial antibody libraries (HuCAL) based on modular consensus frameworks and CDRs randomized with trinucleotides", J. Mol. Biol. 296:57-86 (2000).

Kantor, et al., "The experimental animal models for assessing treatment of restenosis" Cardiovasc Radiat Med. 1 (1):48-54 (1999).

Kaplan, et. al., "A Prealbumin Activator of Preallirrein. 3. Appearance of Chemotactic Activity for Human Neutrophils by the conversion of Human Prekallikrein", J. Exp. Med. vol. 135(1), p. 81-97; p. 92 Fig 10, p. 93 (1972).

Katz et al., "Animal models of vasculitides" Clin Rev Allergy Immunol. 35(1-2): 11-8 (2008).

Kaufman, et al., "Amplification and expression of sequences cotransfected with a modular dihydrofolate reductase complementary dna gene", Mol. Biol. 159:601 621 (1982).

Kemp et al., "Synthesis of Peptide-Functionalized Daicylaminoepinodolidiones," Tetrahedron Letters, 29:5077-5080 (1988).

Kido et al., "Kunitz-type Protease Found in Rat Mast Cells," J. Biol. Chem. 263(34):18104-18107 (1988).

Kido et al., "Protease Specificity of Kunitz Inhibitor Domain of Alzheimer's Disease Amyloid Protein Precursor," Biochemical and Biophysical Research Communications, 167:716-721 (1990).

Kirchhoff, et al., "A Major Human Epididymis-Specific cDNA Encodes a Protein with Sequence Homology to Extracellular Proteinase Inhibitors," Biology of Reproduction, 45:350-357 (1991).

Kline, et al. "Hirulog Peptides with Scissile Bond Replacements Resistant to Thrombin Cleavage," Biochem. Biophys. Res. Comm., 177:1049-1055 (1991).

Ko, et. al., "Biotransformation of uridine monophosphate (UMP) and glucose to uridine diphosphate-glucose (UDPG) by *Candida saitoana* KCTC7249 cells." Appl Biochem Biotechnol.; 60(1):41-8 (Jul. 1996).

(56) References Cited

OTHER PUBLICATIONS

Kobayashi, et. al., "Amended structure of side chains in a cell wall mannan from *Candida albicans* serotype A strain grown in yeast extract—Sabouraud liquid medium under acidic conditions: detection of the branched side chains corresponding to antigenic factor 4.", FEMS Microbiol Lett.;152(2):235-42 (Jul. 15, 1997).
Koizumi et al., Experimental studies of ischemic brain edema. 1. A new experimental model of cerebral embolism in rats in which recirculation can be introduced in the ischemic area. Jpn J Stroke 1986;8:1-8.
Kozyr, et. al., "Production of DNA-hydrolyzing antibody BV04-01 Fab fragment in methylotrophic yeast *Pichia pastoris*" Mol Biol (Mosk). Nov.-Dec. 2004;38(6):1067-75.
Krough et al. "Hidden Markov models in computational biology. Applications to protein modeling." (1994) J. Mol. Biol. 235:1501-1531.
Kurjan & Herskowitz, "Structure of a Yeast Pheromone Gene (MF?): A putative ?-Factor Precursor Contains Four Tandem Copies of Mature ?-Factor," Cell, 30: 933-943 (1982).
Laskowski, et al., "Inhibitors with Class-Specific Reactive Sites," Ann. Rev. Biochem., 49:593-626 (1980).
Leatherbarrow, et al., "Design of a Small Peptide-Based Proteinase Inhibitor by Modeling the Active-Site Region of Barley Chymotrypsin Inhibitor 2," Biochemistry, 30:10717-10721 (1991).
Leeb-Lundberg et al. "International union of pharmacology. XLV. Classification of the kinin receptor family: from molecular mechanisms to pathophysiological consequences", (2005) Pharmacol Rev 57, 27-77.
Levy Jerrold H et al: "The therapeutic potential of a kallikrein inhibitor for treating hereditary angioedema.", Expert Opinion on Investigational Drugs Sep. 2006 LNKD-PUBMED:16916274,vol. 15, No. 9, Sep. 2006, pp. 1077-1090.
Ley et al., "Obtaining a Family of High-Affinity, High Specificity Protein Inhibitors of Plasmin and Plasma Kallikrein," Molecular Diversity, 2:119-124, (1996).
Lilla et al., "Active plasma kallikrein localizes to mast cells and regulates epithelial cell apoptosis, adipocyte differentiation, and stromal remodeling during mammary gland involution" J Biol Chem. 284(20):13792-13803 (2009).
Lohmann, et al., Plasmin- and Plasminogen-Activator Inhibitors after Excimer Laser Photorefractive Keratectomy: New Concept in Prevention of Postoperative Myopic Regression and Haze, Refractive and Corneal Surgery, 9:300-302, (1993).
Longa et al., "Reversible middle cerebral artery occlusion without craniectomy in rats" Stroke 20 (1): 84-91 (1989).
Lucas, et al., "The Binding of Human Plasminogen to Fibrin and Fibrinogen," J. Biol. Chem., 258:4249-4256 (1983).
Lumry et al, Interim Results of EDEMA2, A Multicenter, Open-Label, Repeat-Dosing Study of Intravenous and Subcutaneous Administration of Ecallantide (DX-88) in Hereditory Angioedema. J. Allergy and Clinical Immunology 117(2)(Suppl. 1):S179 Abstract 699 (2006).
Macgilchrist, "Effect of the Serine Protease Inhibitor, Aprotinin, on Systemic Haemodynamics and Renal Function in Patients with Hepatic Cirrhosis and Ascites," Clin. Sci., 87:329-335 (1994).
Mann et al., Hemostasis and Thrombosis, Chapter 10, 2nd Edition, Basic Principles and Clinical Practice: 148-161 (1987).
March, Advanced Organic Chemistry, 3rd Edition, Reactions, Mechanisms, and Structure, John Wiley and Sons, New York: 396-398; 1057-1060; 1099-1100 (1985).
Markland et al., "Iterative Optimization of High-Affinity Protease Inhibitors Using Phage Display. 1. Plasmin," Biochemistry, 35:8045-8057 (1996).
Markland et al., "Iterative Optimization of High-Affinity Protease Inhibitors Using Phage Display. 2. Plasma Kallikrein and Thrombin," Biochemistry 35(24):8058-67 (1996).
Markland et al., "Selection for Protease Inhibitors Using Bacteriophage Display," Methods Enzymol., 267:28-51 (1996).
Markland, Cell. Biochem. Supp., 1994, O, vol. 18D, pp. 157, Abstract S 331.
Martin et al., "Animal models of neuropathic pain" Methods Mol Med. 84:233-42 (2003).
Mathews, et al., Biochemistry, The Benjamin Cummins Publishing Co., Inc. Redwood City CA: 208-212 (1990).
Mattheakis et al. "An in vitro polysome display system for identifying ligands from very large peptide libraries" Proc. Natl. Acad. Sci. USA 91:9022 (1994).
Mayzel-Oreg, "Microsphere-induced embolic stroke: an MRI study" Magn Reson Med 51: 1232-8 (2004).
McCarty, "Crystal-induced inflammation of the joints," Annual Reviews of Medicine, vol. 21, pp. 357-366 (1970).
McConnell et al., "New Leupeptin Analogues: Synthesis and Inhibition Data," J. Med. Chem., 33:86-93 (1990).
Merriam-Webster reference for the term "prevent." web date: 2010. 2 pages.
Merrifield, "Solid Phase Peptide Synthesis. I. The Synthesis of a Tetrapeptide," Am. Chem. Soc. 85:2149-2154 (1963).
Miyajima, et al., Secretion of Mature Mouse Interleukin-2 by *Saccharomyces cerevisiae*: Use of a General Secretion vector Containing Promoter and Leader Sequences of the Mating Pheromone ?-factor, Gene, 37:155-161 (1985).
Monteseirin, et al., "Plasma Kallikrein Amidolytic Activity in Bronchial Asthma," Allergol. Immunopathol., (Madr)., 20:211-214 (1992).
Moreland, "Intra-articular hyaluronan (hyaluronic acid) and hylans for the treatment of osteoarthritis: mechanisms of action," Arthritis Res. Ther, 2003, Vol. 5, pp. 54-67.
Morishita, et al., "Novel factor Xa and plasma kallikrein inhibitory-activities of the second Kunitz-type inhibitory domain of urinary trypsin inhibitor" Thromb Res, 73(3-4): p. 193-204 (1994).
Morrison "Transfectomas provide novel chimeric antibodies." (1985) Science 229:1202-1207.
Murkin et al., "Aprotinin significantly decreases bleeding and transfusion requirements in patients receiving aspirin and undergoing cardiac operations," J. Thorac. Cardiovasc. Surg., vol. 107, pp. 554-561 (1994).
Nadkarni, A. et al., "Optimization of a mouse recombinant antibody fragment for efficient production from *Escherichia coli*" 2007 Protein Expr Purif 52(1):219-29.
Fife, et al, "Cartilage matrix glycoprotein is present in serum in experimental canine osteoarthritis" J Clin Invest. 84(5):1432-1439 (1989).
Fraedrich, et al., "Reduction of Blood Transfusion requirement in Open Heart Surgery by Administration of High Doses of Aprotinin-Preliminary Results," Thorac Cardiovasc Surgeon, 37:89-91 (1989).
Fredrich et al., "A new animal model of venous thrombosis in rats with low flow conditions in the venous blood stream" Blood Coagul Fibrinolysis. 5(2):243-8 (1994).
Freidinger, et al., "Protected Lactam-Bridged Dipeptides for Use as Conformational Constraints in Peptides," Journal of Organic Chemistry, 47:104-109 (1982).
Frisbie, "An animal model for venous thrombosis and spontaneous pulmonary embolism." Spinal Cord 43, 635-639 (2005).
Galeffi, et. al., "Functional expression of a single-chain antibody to ErbB-2 in plants and cell-free systems" J Transl Med. Sep. 29, 2006;4:39.
Gardell, et al., "The Search for the Ideal Thrombolytic Agent: Maximize the Benefit and Minimize the Risk," Toxicologic Pathology, 21(2):190-198 (1993).
Gasser, et. al., "Engineering of *Pichia pastoris* for improved production of antibody fragments" Biotechnol Bioeng. Jun. 5, 2006;94(2):353-61.
Gerriets et al., "Complications and pitfalls in rat stroke models for middle cerebral artery occlusion: a comparison between the suture and the macrosphere model using magnetic resonance angiography", Stroke 35: 2372-2377 (2004).
Gerriets et al., "The macrosphere model: evaluation of a new stroke model for permanent middle cerebral artery occlusion in rats" J Neurosci Methods 122: 201-11 (2003).
Girard et al., "Functional Significance of the Kunitz-type Inhibitory Domains of Liporotein-Associated Coagulation Inhibitor," Nature, 338:518-520 (1989).

(56) References Cited

OTHER PUBLICATIONS

Girard, et al., "Structure of the Human Lipoprotein-associated Coagulation Inhibitor Gene," The Journal of Biological Chemistry, 266:5036-5041 (1991).

Goldenberg et al., "Circular and circularly permuted forms of bovine pancreatic trypsin inhibitor," J. Mol. Biol., vol. 165, pp. 407-413 (1983).

Gomez-Jorge et al., "The Double-Tuck Model: A New Animal Model of Arterial Thrombosis" J. Vasco Inter. Rad. 9 (4): 633-638 (1998).

Gonzalez-Quevedo et al., The Synthetic Kunitz Domain Protein DX88 to Treat Angioedema in Patients with Hereditary Angioedema, International Immunopharmacology 2(9):1318 Abstract 205 (2002).

Gouzy et al. "Whole genome protein domain analysis using a new method for domain clustering" (1999) Computers and Chemistry 23:333-340.

Graham et al., "Animal models of ischemic stroke: balancing experimental aims and animal care", Comp Med 54: 486-496 (2004).

Greilich et al., "Antigibrinolytic therapy during cardiopulmonary bypass reduces proinglammatory cytokine levels: a randomized, double-blind, placebo-controlled study of x-aminocaproic acid and aprotinin," J. Thorac. Cardiovasc. Surg., 2003, vol. 126, pp. 1498-1503.

Gribskov et al. "Profile analysis." (1990) Meth. Enzymol. 183:146-159.

Gribskov et al. "Profile analysis: detection of distantly related proteins." (1987) Proc. Natl. Acad. Sci. USA 84:4355-4358.

Grimaldi et al., "Trasylol in the treatment of acute arthritis due to microcrystals," Reumatismo, vol. 23, No. 5, pp. 217-221, (1971) (Abstract only).

Guzman et al. "Mono-iodoacetate-induced histologic changes in subchondral bone and articular cartilage of rat femorotibial joints: an animal model of osteoarthritis." Toxicol Pathol. 31(6):619-24 (2003).

Han, Eun D. et al., Increased Vascular Permeability in C1 Inhibitor-Deficient Mice Mediated by the Bradykinin Type 2 Receptor, J. Clinical Investigation 109(8):1057-1063 (2002).

Han, Eun D. Reversal of the Increased Vascular Permeability in C1 Inhibitor Deficient Mice: Therapeutic Approaches, International Immunopharmacology 2(9):1315 Abstract 176 (2002).

Hanes et al., "Picomolar affinity antibodies from a fully synthetic naive library selected and evolved by ribosome display" Nat Biotechnol. 18:1287-92 (2000).

Hanes et al., "Selecting and evolving functional proteins in vitro by ribosome display" Methods Enzymol. 328:404-30 (2000).

Harvey, et. al., "Engineering of recombinant antibody fragments to methamphetamine by anchored periplasmic expression" J Immunol Methods. (Nov. 22, 2005).

Hoet, et al., "Generation of high-affinity human antibodies by combining donor-derived and synthetic complementarity-determining-region diversity" Nat Biotechnol. 23(3)344-8 (2005).

Hoogenboom et al. "Natural and designer binding sites made by phage display technology" Immunol Today 2:371-8 (2000).

Hoogenboom et al., "Antibody phage display technology and its applications" Immunotechnology 4:1-20 (1998).

Hoover, et al., "Amino Acids of the Recombinant Kringle 1 Domain of Human Plasminogen that Stabilize Its Interaction w-Amino Acids," Biochemistry, 32:10936-10943 (1993).

Hortin, et al., "Allosteric Changes in Thrombin's Activity Produced by peptides Corresponding to Segments of Natural Inhibitors and Substrates," The Journal of Biological Chemistry, 266:6866-6871 (1991).

Horwitz, et. al., "Secretion of functional antibody and Fab fragment from yeast cells.", Proc Natl Acad Sci U S A. 85 (22):8678-82 (Nov. 1988).

Hostomsky, et al., "Solid Phase Assembly of Cow Colostrum Trypsin Inhibitor Gene," Nucleic Acids Research, 15:4849-4856 (1987).

Huge et al. "A model to investigate postoperative ileus with strain gauge transducers in awake rats" J Surg Res. 74 (2):112-8 (1998). (Abstact Only).

Huston et al. "Protein engineering of antibody binding sites: Recovery of specific activity in anti-digoxin single-chain Fv analogue produced in *Escherichia coli*", Proc. Natl. Acad. Sci. USA 85:5879-5883 (1988).

Hynes et al., "X-Ray Crystal Structure of the Protease Inhibitor Domain of Alzheimer's Amyloid, ?-Protein Precursor," Biochemistry, 29:10018-10022 (1990).

International Preliminary Report on Patentability from International Application No. PCT/US2008/073665 mailed Mar. 4, 2010.

International Preliminary Report on Patentability from International Application No. PCT/US2008/074061 mailed Mar. 4, 2010.

International Search Report dated Jun. 1, 2010 for Application No. PCT/US2010/020257.

International Search Report for application PCT/US12/20470 dated Apr. 30, 2012.

International Search Report for PCT/US11/20377 dated Jun. 28, 2011.

International Search Report from international Application No. PCT/US03/17802, dated Oct. 30, 2003.

International Search Report from International Application No. PCT/US2008/074061 mailed Dec. 29, 2008.

International Search Report including Written Opinion received in PCT/08/73665, dated Feb. 5, 2008.

International Search Report including Written Opinion received in PCT/US08/74061, dated Dec. 28, 2008.

International Search Report received in PCT/US07/63703, dated Dec. 21, 2007.

Jefferis et al., "IgG-Fc-mediated effector functions: Molecular definition of interaction site for effector ligands and the role of gylcosylation", Immunol. Rev. 163:59-76, (1998).

Jones, et al., "Severe prekallikrein deficiency associated with homozygosity for an Arg94Stop nonsense mutation" Br J Haematol, 2004. 127(2): p. 220-3.

Jonkam et al., "Effects of the bradykinin B2 receptor antagonist icatibant on microvascular permeability after thermal injury in sheep" Shock, 28:704-709 (2007).

De Agostini et al., Human plasma kallikrein and C1 inhibitor form a complex possessing an epitope that is not detectable on the parent molecules: demonstration using a monoclonal antibody. Proc Natl Acad Sci U S A. Aug. 1985;82(15):5190-3.

Jorg et al., Kinetic analysis of plasminogen activation by purified plasma kallikrein. Thromb Res. Aug. 1, 1985;39(3):323-31.

Raspi, Kallikrein and kallikrein-like proteinases: purification and determination by chromatographic and electrophoretic methods. J Chromatogr B Biomed Appl. Sep. 20, 1996;684(1-2):265-87.

Schneider et al., Critical role of kallikrein in hereditary angioedema pathogenesis: a clinical trial of ecallantide, a novel kallikrein inhibitor. J Allergy Clin Immunol. Aug. 2007;120(2):416-22. Epub Jun. 7, 2007.

Schoonbroodt et al., Human antibodies selected by phage display as potent and selective protease inhibitors. Human Antibodies. 2007;16(1-2):18-22.

Sexton et al., Discover and characterization of fully human monoclonal antibody inhibitor of plasma kallikrein for the treatment of plasma kallikrein-mediated edema. J Allergy Clin Immunol. Feb. 2013;131(2):AB32. Suppl S. Annual meeting of the American Academy of Allergy, Asthma, and Immunology. San Antonio, TX, USA; Feb. 22-26.

Tang et al., Expression, crystallization, and three-dimensional structure of the catalytic domain of human plasma kallikrein. J Biol Chem. Dec. 9, 2005;280(49):41077-89. Epub Sep. 30, 2005.

Wark et al., Latest technologies for the enhancement of antibody affinity. Adv Drug Deliv Rev. Aug. 7, 2006;58(5-6):657-70. Epub May 22, 2006.

U.S. Appl. No. 12/985,914, filed Jan. 6, 2011, Sexton et al.

U.S. Appl. No. 11/322,960, filed Dec. 30, 2005, Ladner et al., Abandoned.

U.S. Appl. No. 11/796,272, filed Apr. 27, 2007, Ladner et al., Abandoned.

U.S. Appl. No. 11/934,181, filed Nov. 2, 2007, Ladner et al., Pending.

U.S. Appl. No. 11/930,018, filed Oct. 30, 2007, Ladner et al., Pending.

(56) References Cited

OTHER PUBLICATIONS

U.S. Appl. No. 11/931,635, filed Oct. 31, 2007, Ladner et al., Abandoned.
U.S. Appl. No. 11/931,373, filed Oct. 31, 2007, Ladner, Pending.
U.S. Appl. No. 11/929,729, filed Oct. 30, 2007, Ladner et al., Pending.
U.S. Appl. No. 11/860,853, filed Sep. 25, 2007, Ladner et al., Abandoned.
U.S. Appl. No. 11/931,695, filed Oct. 31, 2007, Ladner et al., Abandoned.
U.S. Appl. No. 11/929,876, filed Oct. 30, 2007, Ladner et al., Abandoned.
U.S. Appl. No. 11/929,822, filed Oct. 30, 2007, Ladner et al., Pending.
U.S. Appl. No. 11/929,685, filed Oct. 30, 2007, Ladner et al., Abandoned.
U.S. Appl. No. 11/930,700, filed Oct. 31, 2007, Ladner et al., Abandoned.
U.S. Appl. No. 11/930,802, filed Oct. 31, 2007, Ladner et al., Abandoned.
U.S. Appl. No. 11/930,897, filed Oct. 31, 2007, Ladner et al., Abandoned.
U.S. Appl. No. 11/931,810, filed Oct. 31, 2007, Blair et al., Pending.
U.S. Appl. No. 11/931,665, filed Oct. 31, 2007, Blair et al., Pending.
U.S. Appl. No. 11/931,496, filed Oct. 31, 2007, Blair et al., Abandoned.
U.S. Appl. No. 11/931,361, filed Oct. 31, 2007, Blair et al., Pending.
U.S. Appl. No. 11/932,098, filed Oct. 31, 2007, Blair et al., Pending.
U.S. Appl. No. 11/932,015, filed Oct. 31, 2007, Blair et al., Abandoned.
U.S. Appl. No. 11/932,184, filed Oct. 31, 2007, Blair et al., Abandoned.
U.S. Appl. No. 11/931,941, filed Oct. 31, 2007, Blair et al., Abandoned.
U.S. Appl. No. 11/804,388, filed May 18, 2007, Blair et al., Pending.
U.S. Appl. No. 11/716,278, filed Mar. 9, 2007, Clark et al., Pending.
U.S. Appl. No. 10/016,329, filed Oct. 26, 2001, Markland et al., Abandoned.
U.S. Appl. No. 12/580,903, filed Oct. 16, 2009, Markland et al., Pending.
U.S. Appl. No. 12/985,914, filed Jan. 6, 2011, Sexton, Pending.

\* cited by examiner

```
X63-G06                                                    CAAGAGACATCCAGAGATGACCCAGTCTCCAGGCACCCTGTCTTTGTCTCCAGGGGAAAGAGCC
X81-B01          ---GAGATCGTGCTGACTCAGTCCCCTGGCCAGTCCCTGTCTCTGTCTCCCGGCGAGAGAGCC
**  * ***       * ********** ***************** ********* ** ** *********

X63-G06         ACCCTCTCCTGCAGGACCAGTCAGAGTCAATTTGTTAACAGCAACTACTTAGCCTGGTACCAACAG
X81-B01         ACCCTGTCCTGCGCCGGACCTCCCAGTTCGTGAACTCGTGAACTCCAACTACCTGGCTTGGTATCAGCAG
******  ***** ** ***  ** *****  * ** ******  *** **** ***

X63-G06         ACACCTGGCCAGGCTCCCAGGCTCCTCATCTATGGTGCATCCAGCAGGGCCACTGGCATC
X81-B01         AAGCCAGGCCAGGCCCCCAGGCCCCTAGACTGCTGATCTACGGCGCCTCTTCCAGAGCCACCGGCATC
** *  ********** *  ******* **  * ****** *** *** ** *******

X63-G06         CCAGACAGGTTCAGTGCACTGGTATGGGACAGACTTCACTCTCACCATCAGCAGACTG
X81-B01         CCTGACCGGTTCTCCGGCTCTGGCTCTGGCACCGACTTCACCCTGACCATCTCCCGGCTG
*** *** ***** *  ****** ** ***  ******** **** *** * ****

X63-G06         GAGCCTGAAGATTATGGAACTTACTACTGTCAGCAGCATAATAGCTATCCGCTCACGTTC
X81-B01         GAACCTGAGGACTTCGCCGTGTACTACTGCCAGCAGTCCGCCGACCAGCCCGTGGACGTTC
** * ******  **  *  * ******* ****** ***** ********** * ***

X63-G06         GGCCAAGGGACCAGAGTGGAAATCAAA
X81-B01         GGCCAGGGCACCAAGGTGGAGATCAAG
***** ** ****  ***** *****
```

FIGURE 4

```
X63-G06    QDIQMTQSPGTLSLSPGERATLSCRTSQFVNSNYLAWYQQTPGQAPRLLIYGASSRATGI
X81-B01    -EIVLTQSPGTLSLSPGERATLSCRTSQFVNSNYLAWYQQKPGQAPRLLIYGASSRATGI
           * *****************************************************

X63-G06    PDRFSGTGYGTDFTLTISRLEPEDYGTYYCQQSSRTPWTFGQGTRVEIK
X81-B01    PDRFSGSGSGTDFTLTISRLEPEDFAVYYCQQSSRTPWTFGQGTKVEIK
           ****** * ************** ******************* ****
```

FIGURE 5

```
X81-B01    GAGGTGCAATTGCTGGAATCCGGCGGAGGTCTGGTGTGCAGCCTGGCGGCTC
X63-G06    GAAGTTCAATTGTTAGAGTCTGGTGTGGCGGTCTTGTTCAGCCTGGTGGTTC
           ** ** ******* ** ***** ***** ** ***** ***** *****  **

X81-B01    CCTGAGACTGTCTTGCCGCCGACCTTCACCTTCTCCCACTACCTGA
X63-G06    TTTACGTCTTTCTTGCGCTGCTTCCGGATTCACTTTCTCTCATTACCTTA
             *  *  ***** ***  ** *  ** ** ** ****** ** ***** *

X81-B01    TGACCTGGGGTGCGCCAGGCTCCTGGCAAGGGCCTCGAATGGTGTCCTAC
X63-G06    TGACTTGGGGTTCGCCAAGCTCCTGGTAAAGGTTTGGAGTGGGTTTCTTAT
           **** ****** ***** ******** * *** *  ** **** * ** *

X81-B01    ATCTCCCCTCTGGCGCCACACCATCTACGCCGACTCCGTGAAGGGCCG
X63-G06    ATCTCTCCTTCTCGTGGCCATACTATTTATGCTGACTCCGTTAAAGGTCG
           ***** *** **  * ****  *  **  * ** ****** ** ****

X81-B01    GTTCACCATCTCCCGGGACAACTCCAAGAACACCCTGTATCTGCAGATGA
X63-G06    CTTCACTATCTCTAGAGACAACACTAAGAATACTCTACTTGCAGATGA
            ****** *****   ****** *  ***** ** ** * *********

X81-B01    ACTCCCTGAGGGCCGAGGACACCGCCGTGTACTACTGCGCCAGGGTGCC
X63-G06    ACAGCTTAAGGCTGAGGACACACGGCCGTGTATTACTGTGCGAGAGTGGCC
           **   * ***** ******** **  ****** ***** **  **** **

X81-B01    AGAGGAATCGCCGCCAGTCCCGACCTCCTACTTCGACTACTGGGGCCA
X63-G06    CGGGGGATAGCAGCTCGATCGGCGAACCAGCTACTTTGACTACTGGGGCCA
            *   **** ** **    ** * * *   *****  *************

X81-B01    GGGCACCCTGGTGACCGTGTCCTCC
X63-G06    GGGAACCCTGGTCACCGTCTCAAGC
           *** ********  *****  **  *
```

FIGURE 6

```
X81-B01    EVQLLESGGGLVQPGGSLRLSCAASGFTFSHYLMTWVRQAPGKGLEWVSY
X63-G06    EVQLLESGGGLVQPGGSLRLSCAASGFTFSHYLMTWVRQAPGKGLEWVSY
           **************************************************

X81-B01    ISPSGGHTIYADSVKGRFTISRDNSKNTLYLQMNSLRAEDTAVYYCARVA
X63-G06    ISPSGGHTIYADSVKGRFTISRDNSKNTLYLQMNSLRAEDTAVYYCARVA
           **************************************************

X81-B01    RGIAARSRTSYFDYWGQGTLVTVSS
X63-G06    RGIAARSRTSYFDYWGQGTLVTVSS
           *************************
```

FIGURE 7

```
Human   ----------------MILFKQATYFISLFATVSCGCLTQLYENAFFRGGDVASMYTPNAQYCQMRCT  52
Cow     ----------------MIALRQAAYFICLFATVSCGCLTQLYHNIFFRGGDVSAMYTPDAQYCQLMCT  52
Mouse   ----------------MLFNRVGYFVSLFATVSCGCMTQLYKNTFFRGGDLAAIYTPDAQYCQKMCT  52
Rat     ----------------MLFKQVGYFVSLFATVSCGCLSQLYANTFFRGGDLAAIYTPDAHCQKMCT   52
Pig     MEVIVLFRIISFRQAVYFMCLFAAVSCGCLPQLHKNTFFRGGDVSAMYTPSARHCQMMCT         60
Frog    ----------------MACYSSLLFLLLFTLVSGGCISELYQDIYWQGGDLRSVFAPDVEYCQLVCT  52
MACACA  ----------------MILFKQATYFISLFATVSCGCLTQLYKNTFFRGGDVASMYTPNAQHCQMMCT 52
Dog     ----------------MLIKLP------LKWVSQGCLTQLYKNTFFKGGDLTAMYTPNAHHCQMMCT   45
                                  ..     **  ***: :   :   :::::**   :* **

Human   FHPRCLLFSFLPASSINDMEKRFGCFLKDSVTGTLPKVHRTGAVSGHSLKQCGHQISACH 112
Cow     FHPRCLLFSFLPENSTSDADKRFGCFLKDSVTGTLPRVSRTGAISGHSLKRCGHQISACH 112
Mouse   FHPRCLLFSFLAVTPPKETNKRFGCFMKESITGTLPRIHRTGAISGHSLKQCGHQISACH 112
Rat     FHPRCLLFSFLAVSPTKETDKRFGCFMKESITGTLPRIHRTGAISGHSLKQCGHQLSACH 112
Pig     FHPRCLLFSFLPADSTVTDKRFGCFLKDSVTGMLPRVLRENAISGHSLKQCGHQIRACH  120
Frog    FSPRCLMFSYLPASWPK-ENERFACYLKESATNMLPKVTLTGVISGHSLKNCKSKINVCR 111
MACACA  FHPRCLLFSFLPASSINDMEKRFGCFLKDSVTGTLPKVRRAGAISGHSLKQCGHQISACH 112
Dog     FHPRCLLFSFLPESSTNDVNKRFGCFLKDSVTETLPRMSWTSAISGHSLKQCGHQISACH 105
        *.****:**:*      :    :***.:**  ** ::    ..:********:  ..

Human   RDIYKGVDMRGVNFNVSKVSSVEECQKRCTNNIRCQFFSYATQTFHKAEYRNNCLLKYSP 172
Cow     RSTYKGIDMRGVNFNASKVRSAKECQERCTNNIHCQFFTYATKTFFSAEYRNTCLLKRSP 172
Mouse   RDIYKGLDMRGSNFNISKTDNIFECQKLCTNNFHCQFFTYATSAFYRPEYRKKCLLKHSA 172
Rat     QDIYEGLDMRGSNFNISKTDSIFECQKLCTNNIHCQFFTYATKAFHRPEYRKSCLLKRSS 172
Pig     RDIYKGIDMRGVNFNVSKVKTVEECQERCTNSIHCLFFTYATQAFNNAEYRNNCLLKHSP 180
Frog    DKNFPGIDMIGTNYNVTSTANVQQCKEGCTNDIYCQYFTYVTQEFHSAQLRNRCYFKYSG 171
MACACA  RDIYKGIDMRGVNFNVSKVSSVEECQKRCTNNIRCQFFSYATQTFHNAEYRNTCLLKHSP 172
Dog     RDIHKGIDMRGVNFNVSKVKSVEECQKKCTNSIHCQFFTYATETYNVEYRNSCLLKNGP  165
         .  *:**:* *:*. :. .  :*:. *:*.: * :*:*.*. :   **:. *:  .

Human   GGTPTAIKVLSNVESGFSLKPCALSEIGCHMNIFQHLAFSDVDVARVLTPDAFVCRTICT 232
Cow     QGTPTRIKVLSDVESGFSLKACGNSKIGCRVDIFQHSAFSDVDVAGLIAPDAFVCRTICT 232
Mouse   SGTPTSIKSADNLVSGFSLKSCALSEIGCPMDIFQHSAFADLNVSQVITPDAFVCRTICT 232
Rat     SGTPTSIKPVDNLVSGFSLKSCALSEIGCPMDIFQHFAFAFADLNVSQVVTPDAFVCRTVCT 232
Pig     GGTPTSIKVLANVESGFSLKPCADSEIGCHMDIFQHLAFSDVDVARVIAPDAFVCRTICT 240
Frog    KGMPTRIRLLDNVISGFSLKACGKSSLGCQNDLFQNMELPGETLTRVFAPDVLTCQKICT 231
MACACA  GGTPTTIKVLNNVESGFSLKPCALSEIGCHMNIFQHLAFSDVDVARVLAPDAFVCRTICT 232
Dog     GGTPSSIKVLADVVSGFSLKSCALSEIGCHMNIFQHLAFSDVDVARVVTPDAFVCRTQTCT 225
         * *: *:.   : .*****:*..*.:** ::::*: ::  :    : .** : *: .*
```

FIGURE 10A

```
Human    YHPNCLFTFYTNVWKIESQRNVCLLKTSESGPTSSSTPQE---NTISGYSLLICKRTLP  289
Cow      YHPSCLFTFYTNAWKTDSQRNVCFLKTSQSGSPSSPTPQE---NAISGYSLLICKQTLP  289
Mouse    FHPNCLFTFYTNEWETESQRNVCFLKTSKSGRPSPPIPQE---NAISGYSLLICKTRP   289
Rat      FHPNCLFTFYTNEWFTFSQRNVCFLKTSKSGRPSPPTTQF---NAVSGYSLFTCRKARP  289
Pig      YHPNCLFTFYTNAWKIESQRNVCFLKTSHSCTPFPIPQE---NAISCYSLLICKQTLP   297
Frog     FYPNCLFTFFKKDSKDPLQRNVCYRTSKGIPDEVINKE---HTISGFSLLSCKFSPS    288
MACACA   YHPSCLFTFYTNAWKIESQRRVCMLAGSQDGAAHSSLGDARLRLKQKMKNKQTKKNTLP 292
Dog      YHPNCLFTFYTKAWHLEPQRNVCFLKTSKSGTPSSPTSQK---NAMSGYSLLTCKKALP  282
         ::*.*******:::.  .    **.:**.: *    .       . . :*    * .

Human    --EPCHSKIYPGVDFGGEELNVTFVKGVNVCQETCKMIRCQFPTYSLLPEDCKEEKCKC  347
Cow      GTEPCHSKIYPQVAFEGEELHVTFVKVDGCQETCKMIRCQFPTYSLFPEDCRGEKCKC   349
Mouse    --EPCHSKIYSCVDFEGEELNVTFVQGADVCQETCTKIIRCQFFIYSLLPQDCKEEGCKC 347
Rat      --EPCHFKIYSCVAFEGELNATFVQGADACQETCTKTIRCQFFTYSLLPQDCKAEGCKC  347
Pig      --EPCHSKIYSLVDFEGEELNVTFVQANLQETCTK1LRCQFTYSLHPEDCRGEKCKC    355
Frog     --VCPLITMLSDSEFLGDELLVEEVSGEKECQQACTNNIRCQFFTVGPVKSGCLEKKCKC 345
MACACA   --EPCHSKIYPGVDFGGEELNVTFVKGVNVCQETCKMIRCQFPTYSLLPEDCKEEKCKC  350
Dog      EPCHSKIYSGVDFTGCMTYGTRVSSGYSLRLCKSGDSSVCT--TKTSTR-VGGTNSSWGEWPWQ 340
         *     :  ::  :.*..*  **:::**: ****** *

|Start Catalytic Domain
Human    FLRLSMDGSPTRIAYGTQGSSGYSLRLCNTGDNSVCT--TKTSTR-VGGTNSSWGEWPWQ 405
Cow      SLRLSLDGSPTNITYGTQASSGYSLRLCKRGDSRVCT--TKR-TR-VGGTNASWGEWPWQ 406
Mouse    SLRLSTDGSPTRITYGMQGSSGYSLRLCKLVDSPDCT--TKINAR-VGGTNASLGEWPWQ 405
Rat      SLRLSTDGSPTRITYEAQGSSGYSLRLCKVVESSDCT--TKINAR-VGGTNSSLGEWPWQ 405
Pig      SLRLSSDGSPTKITHGMRASSGYSLRLCRSGDHSACA--TKANTR-VGGTDSFLGEWPWQ 413
Frog     HMKISSNGLPTCIRHGNGGISGFSLRLCKMKSVRCCGEPSEHANR-VGGTDSVLGEWPWQ 405
MACACA   FLRLSSDGSPTRITYGTQGSSGYSLRLCNTGDSSVCT--TKTSSR-VGGTNSSWGEWPWQ 408
Dog      SLRLSLDGSPTCMTYGTRVSSGYSLRLCKSGDSSVCT--TKTSTR-VGGTNSSWGEWPWQ 398
         :::*  :* ::  : . **:******   .         **    ******* *****

@@@@@@@@@@                 #@@@@@@@@@@
                  ++++++++++++++++++++++(C1)                    ++
Human    VSLQVKRA   QGGSLIGHQWVLTAAHCFPLQDVWRIYSGILNLSDITKDTPF 463
Cow      VSLQVKQRA--QSHLCGGSIIGRQWVLTAAHCFDGLLSNIWRIYGGILNLSEITTETSF 464
Mouse    VSLQVKLVS--QTHLCGGSIIGRQWVLTAAHCFDGIPYPDVWRIYGGILSLSEITKETPS 463
Rat      VSLQVKLVS--QNHMCGGSIIGRQWILTAAHCFDGIPYPDVWRIYGGILNLSEITNKTPF 463
Pig      VSLQAKLRA--QNHLCGGSIIGHQWVLTAAHCFDGLSLPDIWRIYGGILNLSEITKETPF 471
Frog     VSMHLRLGASYKKHACCGSIISNQWIVTAAHCVAIYPQPQMWIIYSGFVRLNITKSTPF 465
MACACA   VSLQVKLMA--QRHLCGGSLIGHQWVLTAAHCFDCLPLPDVWRIYSGILNLSDITKETPF 466
Dog      VSLQVKLRA--QSHLCGGSIIGRQWVLTAAHCFDELSLPDVWRIYSGILNLSEITKETPF 456
         **:: :   : :.:: ** : .:**::**** . :   .:**:*.*:    ::.:*
```

FIGURE 10B

```
                         @@@@@@@@@@@@
              ++++++++++(C2)    ++++++++(C3)                               ++++++
Human    SQIKEIIIHQNYKV▒G-NHDIALIKLQAPLNYTEFQKPICLPSKGTSTIYTNCWVIGW 522
Cow      SQIKEIIVHPNYKISEG-SHDIALIKLEAPLNFTDLQKAICLPSKDDIKPVYTDCWITGW 523
Mouse    SRIKELIIHQEYKVSEG-NYDIALIKLQTPLNYTEFQKPICLPSKADTNTIYTNCWVTGW 522
Rat      SSIKELIIHQKYKMSEG-SYDIALIKLQTPLNYTEFQKPICLPSKADINTIYTNCWVTGW 522
Pig      SQVKEIIIHQNYKILES-GHDIALLKIETPLNYTDFQKPICLPSRDDTNVVYTNCWVTGW 530
Frog     SELEKIIHPHYTGAGN-GSDIALLKLRTPIVFNDHQKAICLPPSEATLVLPNSCWITGW 524
MACACA   SQIKEIIIHQNYRISEG-NHDIALIKLQAPLNYTEFQKPICLPSKGDTNTIYTNCWVTGW 525
Dog      SQIKEIIIHQNYKITDGGSYDIALIKLEAPLNYTEFQKPICLPSKDDTNTTYTNCWVTGW 516
         *  :::::*:*  .*     *  *****.**:::**: .:. **.:**** .  ..**:****

@@@@@@@@@@                            @@@@@@@@@@@
         ++++++++++(C4)                        ++++++++++++++(C5)           +++++++++++(C6)
Human    G▒SKE▒E▒QNILQKVNIPLVTNEECQKRYQD▒KITQQMVCAGYKEGGK▒ITQQMVCAGYKEGGK▒D▒GGPL 582
Cow      GFTEEKGIQNTLQKANIPLISNEECQKSYRDYKITKQMICAGYKEGGKDACKGDSGGPL 583
Mouse    GYTKEQGETQNILQKATIPLVPNEECQKKYRDYVINKQMICAGYKEGTDACKGDSGGPL 582
Rat      GYTKERGETQNILQKATIPLVPNEECQKKYRDYVITKQMICAGYKEGIDACKGDSGGPL 582
Pig      GFTEEKGEIQNILQKVNIPLVSNEECQKSYRDHKISKQMICAGYKEGGKDACKGESGGPL 590
Frog     GYTEETGSPGNVLQKAEVPPISTECCGSYVETRIDKKVLCAGYKSGKIDACKGDSGGPL 584
MACACA   GFSKEKGEIQDILQKVNIPLVTNEECQKRYQDYKITQRMVCAGYKEGGKDACKGDSGGPL 585
Dog      GFTKERGEIQNSLQKANIPLVPNEECQKKYRDYEVNKQMICAGYKEGGKDACKGDSGGPL 576
         *::::*. :  *.** :   :* *  : :::::****** *.:  :**: :*:****

@@@@@@@@@@
                      ++++(C7)
Human    VCKHNGMWRLVGITSWGEGECARREQP▒VYTKVAEYMDWILEKTQSSDGKAQMQSPA 638
Cow      VCQHEETWHLVGITSWGEGECARREQPGVYTKVAEYVDWILEKTQDSHGQPLRK--- 636
Mouse    VCKHSGRWQLVGITSWGEGECGRKDQPGVYTKVSEYMDWILEKTQSSDVRALETSSA 638
Rat      VCKHSGRWQLVGITSWGEGECARREQPGVYTKVAEYIDWILEKIQSSKERALETSPA 638
Pig      VCKYNGIWHLVGTTSWGEGECARREQPGVYTKVIEYMDWILEKTQDDGQSWMK---- 643
Frog     VCEVDEIWYLTGITSWGEGECARPGKPGVYTRVSTFTNWILEHTKL--------- 629
MACACA   ACKHNGMWRLVGITSWGEGECARREQPGVYTKVAEYMDWILEKTQSSDGNARMQAPA 641
Dog      VCKHNGNWHLVGITSWGEGCGREQPGVYTKVAEYVDWILEKTQVGDGHAGLG--- 629
         .*:     . *.* *********.*   :******:*    :******:::
```

FIGURE 10C

NOTE: The underlined positions are the amino acids that form the catalytic triad (His434, Asp483, and Ser578, numbering based on the human sequence).

PLASMA KALLIKREIN BINDING PROTEINS

This application claims priority to U.S. Application Ser. No. 61/430,442, filed on Jan. 6, 2011. The disclosure of the prior application is considered part of (and is incorporated by reference in) the disclosure of this application.

SEQUENCE LISTING

The instant application contains a Sequence Listing which has been submitted in ASCII format via EFS-Web and is hereby incorporated by reference in its entirety. Said ASCII copy, created on Feb. 24, 2012, is named D237137U.txt and is 1,418,952 bytes in size.

BACKGROUND

Plasma kallikrein is a serine protease. Prekallikrein is the precursor of plasma kallikrein.

SUMMARY

Plasma kallikrein is a serine protease component of the contact system and a potential drug target for different inflammatory, cardiovascular, infectious (sepsis) and oncology diseases (Sainz I. M. et al., Thromb Haemost 98, 77-83, 2007). The contact system is activated by either factor XIIa upon exposure to foreign or negatively charged surfaces or on endothelial cell surfaces by prolylcarboxypeptidases (FIG. 1) (Sainz I. M. et al., Thromb Haemost 98, 77-83, 2007). Activation of the plasma kallikrein amplifies intrinsic coagulation via its feedback activation of factor XII and enhances inflammation via the production of the proinflammatory nonapeptide bradykinin. As the primary kininogenase in the circulation, plasma kallikrein is largely responsible for the generation of bradykinin in the vasculature. A genetic deficiency in the C1-inhibitor protein (C1-INH), the major natural inhibitor of plasma kallikrein, leads to hereditary angioedema (HAE). Patients with HAE suffer from acute attacks of painful edema often precipitated by unknown triggers (Zuraw B. L. et al., N Engl J Med 359, 1027-1036, 2008). Through the use of pharmacological agents or genetic studies in animal models, the plasma kallikrein-kinin system (plasma KKS) has been implicated in various diseases.

Plasma kallikrein binding proteins (e.g., antibodies, e.g., inhibitory antibodies) are useful therapeutic agents for a variety of diseases and conditions, e.g., diseases and conditions that involve plasma kallikrein activity, due to their high potency, specificity, and prolonged serum residency. High potency can translate to efficacy and a low drug dosage, and high specificity can reduce side effects due to the inhibition of related off target serine proteases. In general, small molecule serine proteases are not as specific as antibody inhibitors. Prolonged serum residency can permit infrequent dosing.

In some aspects, the disclosure features an isolated protein (e.g., antibody, e.g., human antibody) that binds to the active form of plasma kallikrein (e.g., human plasma kallikrein and/or mouse plasma kallikrein), and, e.g., does not bind preplasma kallikrein (e.g., human preplasma kallikrein and/or mouse preplasma kallikrein).

In some embodiments, the plasma kallikrein binding protein binds the same epitope or competes for binding with a kallikrein binding protein described herein. In some embodiments, the plasma kallikrein binding protein binds the same epitope or competes for binding with a protein (e.g., epi-Kal2) and/or a small molecule (e.g., AEBSF) described herein and does not bind pre-plasma kallikrein.

In some embodiments, the protein described herein is selected from the group consisting of M162-A04, M199-A08, M160-G12, M142-H08, X63-G06, X101-A01 (also referred to herein as DX-2922), X81-B01, X67-D03, X67-G04, X115-B07, X115-D05, X115-E09, X115-H06, X115-A03, X115-D01, X115-F02, X124-G01 (also referred to herein as DX-2930), X115-G04, M29-D09, M145-D11, M06-D09 and M35-G04.

In some embodiments, the plasma kallikrein binding protein competes with or binds the same epitope as X81-B01 and, e.g., does not bind pre-plasma kallikrein.

In some embodiments, the plasma kallikrein binding protein competes with or binds the same epitope as X67-D03 and, e.g., does not bind pre-plasma kallikrein.

In some embodiments, the plasma kallikrein binding protein competes with or binds to the same site as X101-A01 and, e.g., does not bind pre-plasma kallikrein.

In some embodiments, the plasma kallikrein binding protein competes with or binds to the same site as M162-A04 and, e.g., does not bind pre-plasma kallikrein.

In some embodiments, the plasma kallikrein binding protein competes with or binds to the same site as X115-F02 and, e.g., does not bind pre-plasma kallikrein.

In some embodiments, the plasma kallikrein binding protein competes with or binds to the same site as X124-G01 and, e.g., does not bind pre-plasma kallikrein.

In some embodiments, the plasma kallikrein binding protein competes with or binds to the same site as X63-G06 and, e.g., does not bind pre-plasma kallikrein.

In some embodiments, the plasma kallikrein binding protein does not bind prekallikrein (e.g., human prekallikrein and/or mouse prekallikrein), but binds to the active form of plasma kallikrein (e.g., human plasma kallikrein and/or mouse plasma kallikrein).

In certain embodiments, the protein binds at or near the active site of the catalytic domain of plasma kallikrein, or a fragment thereof, or binds an epitope that overlaps with the active site of plasma kallikrein and, e.g., does not bind preplasma kallikrein.

In some embodiments, the protein binds to one or more amino acids that form the catalytic triad of plasma kallikrein: His434, Asp483, and/or Ser578 (numbering based on the human sequence) and, e.g., does not bind pre-plasma kallikrein.

In some embodiments, the protein binds to one or more amino acids of: Ser479, Tyr563, and/or Asp585 (numbering based on the human sequence) and, e.g., does not bind preplasma kallikrein.

In some embodiments, the plasma kallikrein binding protein binds one or more amino acids of: Arg551, Gln553, Tyr555, Thr558, and/or Arg560 (numbering based on the human kallikrein sequence). In other embodiments, the plasma kallikrein binding protein binds two, three, four or five (i.e., all) amino acids of: Arg551, Gln553, Tyr555, Thr558, and/or Arg560 (numbering based on the human sequence) and, e.g., does not bind pre-plasma kallikrein.

In some embodiments, the plasma kallikrein binding protein binds one or more amino acids of: S478, N481, S525, and K526 (numbering based on the human kallikrein sequence). In other embodiments, the plasma kallikrein binding protein binds two, three or four (i.e., all) amino acids of: S478, N481, S525, and K526 (numbering based on the human kallikrein sequence).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the plasma kallikrein binding protein has an apparent inhibition constant ($K_{i,app}$) of less than 1000, 500, 100, 10, 1, 0.5 or 0.2 nM.

In one embodiment, the HC and LC variable domain sequences are components of the same polypeptide chain.

In another embodiment, the HC and LC variable domain sequences are components of different polypeptide chains. For example, the plasma kallikrein binding protein is an IgG, e.g., IgG1, IgG2, IgG3, or IgG4. The plasma kallikrein binding protein can be a soluble Fab (sFab).

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein. In one embodiment, the plasma kallikrein binding protein is modified to include, e.g., PEGylation, fusion to serum albumin (e.g., human serum albumin), conjugation to human serum albumin, HESylation (HESylation utiliseshydroxyethyl starch ("HES") derivatives linked to drug substances in order to modify the drug characteristics or fusion to a unstructured recombinant polymer (URPs).

In other embodiments, the plasma kallikrein binding protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the plasma kallikrein binding protein is a human or humanized antibody or is non-immunogenic in a human. For example, the protein includes one or more human antibody framework regions, e.g., all human framework regions.

In one embodiment, the plasma kallikrein binding protein includes a human Fc domain, or an Fc domain that is at least 95, 96, 97, 98, or 99% identical to a human Fc domain.

In one embodiment, the plasma kallikrein binding protein is a primate or primatized antibody or is non-immunogenic in a human. For example, the protein includes one or more primate antibody framework regions, e.g., all primate framework regions.

In one embodiment, the plasma kallikrein binding protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the plasma kallikrein binding protein includes human framework regions, or framework regions that are at least 95, 96, 97, 98, or 99% identical to human framework regions.

In certain embodiments, the plasma kallikrein binding protein includes no sequences from mice or rabbits (e.g., is not a murine or rabbit antibody).

In certain embodiments, the plasma kallikrein binding protein is capable of binding to a cell or tissue, e.g., that expresses plasma kallikrein.

In one embodiment, the plasma kallikrein binding protein is physically associated with a nanoparticle, and can be used to guide a nanoparticle to a cell or tissue expressing plasma kallikrein.

In some aspects, the disclosure features an isolated protein (e.g., antibody, e.g., human antibody) that binds the same epitope or competes for binding with a kallikrein binding protein described herein.

In some embodiments, the protein binds the same epitope or competes for binding with a protein (e.g., epi-Kal2) and/or a small molecule (e.g., AEBSF) described herein.

In some embodiments, the isolated protein comprises a heavy chain immunoglobulin variable domain sequence and a light chain immunoglobulin variable domain sequence, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the heavy chain immunoglobulin variable domain sequence comprises one, two, or three (e.g., three) CDR regions from the heavy chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

the light chain immunoglobulin variable domain sequence comprises one, two, or three (e.g., three) CDR regions from the light chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 (respectively).

In some embodiments, the protein inhibits plasma kallikrein (e.g., human plasma kallikrein and/or mouse plasma kallikrein).

In some embodiments, the one, two, or three (e.g., three) CDR regions from the heavy chain variable domain are from X81-B01 and/or the one, two, or three (e.g., three) CDR regions from the light chain variable domain are from X81-B01.

In some embodiments, the one, two, or three (e.g., three) CDR regions from the heavy chain variable domain are from X67-D03 and/or the one, two, or three (e.g., three) CDR regions from the light chain variable domain are from X67-D03.

In some embodiments, the one, two, or three (e.g., three) CDR regions from the heavy chain variable domain are from X63-G06 and/or the one, two, or three (e.g., three) CDR regions from the light chain variable domain are from X63-G06.

In some embodiments, the one, two, or three (e.g., three) CDR regions from the heavy chain variable domain are from M162-A04 and/or the one, two, or three (e.g., three) CDR regions from the light chain variable domain are from MJ162-A04.

In some embodiments, the one, two, or three (e.g., three) CDR regions from the heavy chain variable domain are from X115-F02 and/or the one, two, or three (e.g., three) CDR regions from the light chain variable domain are from X115-F02.

In some embodiments, the one, two, or three (e.g., three) CDR regions from the heavy chain variable domain are from X124-G01 and/or the one, two, or three (e.g., three) CDR regions from the light chain variable domain are from X124-G01.

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the heavy chain immunoglobulin variable domain sequence comprises the heavy chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04, and/or the light chain immunoglobulin variable domain sequence comprises the light chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 (respectively).

In some embodiments, the heavy chain immunoglobulin variable domain sequence comprises the heavy chain variable domain of X81-B01, and/or the light chain immunoglobulin variable domain sequence comprises the light chain variable domain of X81-B01.

In some embodiments, the heavy chain immunoglobulin variable domain sequence comprises the heavy chain variable domain of X67-D03, and/or the light chain immunoglobulin variable domain sequence comprises the light chain variable domain of X67-D03.

In some embodiments, the protein comprises the heavy chain of a protein described herein, and/or the light chain of a protein described herein.

In some embodiments, the protein comprises the heavy chain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

and/or the light chain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 (respectively).

In some embodiments, the protein comprises the heavy chain of X81-B01, and/or the light chain of X81-B01.

In some embodiments, the protein comprises the heavy chain of X67-D03, and/or the light chain of X67-D03.

In some embodiments, the protein comprises the heavy chain of M162-A04, and/or the light chain of M162-A04.

In some embodiments, the protein comprises the heavy chain of X115-F02, and/or the light chain of X115-F02.

In some embodiments, the protein comprises the heavy chain of X124-G01, and/or the light chain of X124-G01.

In some embodiments, the plasma kallikrein binding protein does not bind prekallikrein (e.g., human prekallikrein and/or mouse prekallikrein), but binds to the active form of plasma kallikrein (e.g., human plasma kallikrein and/or mouse plasma kallikrein).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the protein includes one or more of the following characteristics: (a) a human CDR or human framework region; (b) the HC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a LC variable domain described herein; (d) the LC immunoglobulin variable domain sequence is at least 85, 88, 89, 90, 91, 92, 93, 94, 95, 96, 97, 98, 99, or 100% identical to a LC variable domain described herein (e.g., overall or in framework regions or CDRs); (e) the HC immunoglobulin variable domain sequence is at least 85, 88, 89, 90, 91, 92, 93, 94, 95, 96, 97, 98, 99, or 100% identical to a HC variable domain described herein (e.g., overall or in framework regions or CDRs); (f) the protein binds an epitope bound by a protein described herein, or competes for binding with a protein described herein; (g) a primate CDR or primate framework region; (h) the HC immunoglobulin variable domain sequence comprises a CDR1 that differs by at least one amino acid but by no more than 2 or 3 amino acids from the CDR1 of a HC variable domain described herein; (i) the HC immunoglobulin variable domain sequence comprises a CDR2 that differs by at least one amino acid but by no more than 2, 3, 4, 5, 6, 7, or 8 amino acids from the CDR2 of a HC variable domain described herein; (j) the HC immunoglobulin variable domain sequence comprises a CDR3 that differs by at least one amino acid but by no more than 2, 3, 4, 5, or 6 amino acids from the CDR3 of a HC variable domain described herein; (k) the LC immunoglobulin variable domain sequence comprises a CDR1 that differs by at least one amino acid but by no more than 2, 3, 4, or 5 amino acids from the CDR1 of a LC variable domain described herein; (l) the LC immunoglobulin variable domain sequence comprises a CDR2 that differs by at least one amino acid but by no more than 2, 3, or 4 amino acids from the CDR2 of a LC variable domain described herein; (m) the LC immunoglobulin variable domain sequence comprises a CDR3 that differs by at least one amino acid but by no more than 2, 3, 4, or 5 amino acids from the CDR3 of a LC variable domain described herein; (n) the LC immunoglobulin variable domain sequence differs by at least one amino acid but by no more than 2, 3, 4, 5, 6, 7, 8, 9, or 10 amino acids from a LC variable domain described herein (e.g., overall or in framework regions or CDRs); and (o) the HC immunoglobulin variable domain sequence differs by at least one amino acid but by no more than 2, 3, 4, 5, 6, 7, 8, 9, or 10 amino acids from a HC variable domain described herein (e.g., overall or in framework regions or CDRs).

In some embodiments, the protein has an apparent inhibition constant ($K_{i,app}$) of less than 1000, 500, 100, 10, 1, 0.5 or 0.2 nM.

In some embodiments, the antibody does not bind prekallikrein (e.g., human prekallikrein and/or mouse prekallikrein), but binds to the active form of plasma kallikrein (e.g., human plasma kallikrein and/or mouse plasma kallikrein).

In a preferred embodiment, the protein is an antibody (e.g., a human antibody) having the light and heavy chains of antibodies selected from the group consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having the heavy chain of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having the light chain of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having light and heavy antibody variable regions of an antibody selected from the group consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having a heavy chain antibody variable region of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having a light chain antibody variable region of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) light chain CDRs selected from the corresponding CDRs of the group of light chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04. and one or more (e.g., 1, 2, or 3) light chain CDRs selected from the corresponding CDRs of the group of light chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 (respectively).

In a preferred embodiment, the protein is an antibody (e.g., a human antibody) having the light and heavy chains of X81-B01.

In a preferred embodiment, the protein is an antibody (e.g., a human antibody) having the heavy chain of X81-B01.

In a preferred embodiment, the protein is an antibody (e.g., a human antibody) having the light chain of X81-B01.

In a preferred embodiment, the protein is an antibody (e.g., a human antibody) having light and heavy antibody variable regions of an antibody selected from X81-B01.

In a preferred embodiment, the protein is an antibody (e.g., a human antibody) having a heavy chain antibody variable region of X81-B01.

In a preferred embodiment, the protein is an antibody (e.g., a human antibody) having a light chain antibody variable region of X81-B01.

In a preferred embodiment, the protein is an antibody (e.g., a human antibody) having one or more (e.g., 1, 2, or 3) heavy chain CDRs from the corresponding CDRs of the heavy chain of X81-B01.

In a preferred embodiment, the protein is an antibody (e.g., a human antibody) having one or more (e.g., 1, 2, or 3) light chain CDRs from the corresponding CDRs of the light chain of X81-B01.

In a preferred embodiment, the protein is an antibody (e.g., a human antibody) having one or more (e.g., 1, 2, or 3) heavy chain CDRs from the heavy chain of X81-B01 and one or more (e.g., 1, 2, or 3) light chain CDRs from the corresponding CDRs of the light chain of X81-B01.

In a preferred embodiment, the protein is an antibody (e.g., a human antibody) having the light and heavy chains of X67-D03.

In a preferred embodiment, the protein is an antibody (e.g., a human antibody) having the heavy chain of X67-D03.

In a preferred embodiment, the protein is an antibody (e.g., a human antibody) having the light chain of X67-D03.

In a preferred embodiment, the protein is an antibody (e.g., a human antibody) having light and heavy antibody variable regions of an antibody selected from X67-D03.

In a preferred embodiment, the protein is an antibody (e.g., a human antibody) having a heavy chain antibody variable region of X67-D03.

In a preferred embodiment, the protein is an antibody (e.g., a human antibody) having a light chain antibody variable region of X67-D03.

In a preferred embodiment, the protein is an antibody (e.g., a human antibody) having one or more (e.g., 1, 2, or 3) heavy chain CDRs from the corresponding CDRs of the heavy chain of X67-D03.

In a preferred embodiment, the protein is an antibody (e.g., a human antibody) having one or more (e.g., 1, 2, or 3) light chain CDRs from the corresponding CDRs of the light chain of X67-D03.

In a preferred embodiment, the protein is an antibody (e.g., a human antibody) having one or more (e.g., 1, 2, or 3) heavy chain CDRs from the heavy chain of X67-D03 and one or more (e.g., 1, 2, or 3) light chain CDRs from the corresponding CDRs of the light chain of X67-D03.

In a preferred embodiment, the protein is an antibody (e.g., a human antibody) having the light and heavy chains of X124-G01 or X115-F02.

In a preferred embodiment, the protein is an antibody (e.g., a human antibody) having the heavy chain of X124-G01 or X115-F02.

In a preferred embodiment, the protein is an antibody (e.g., a human antibody) having the light chain of X124-G01 or X115-F02.

In a preferred embodiment, the protein is an antibody (e.g., a human antibody) having light and heavy antibody variable regions of an antibody selected from X124-G01 or X115-F02.

In a preferred embodiment, the protein is an antibody (e.g., a human antibody) having a heavy chain antibody variable region of X124-G01 or X115-F02.

In a preferred embodiment, the protein is an antibody (e.g., a human antibody) having a light chain antibody variable region of X124-G01 or X115-F02.

In a preferred embodiment, the protein is an antibody (e.g., a human antibody) having one or more (e.g., 1, 2, or 3) heavy chain CDRs from the corresponding CDRs of the heavy chain of X124-G01 or X115-F02.

In a preferred embodiment, the protein is an antibody (e.g., a human antibody) having one or more (e.g., 1, 2, or 3) light chain CDRs from the corresponding CDRs of the light chain of X124-G01 or X115-F02.

In a preferred embodiment, the protein is an antibody (e.g., a human antibody) having one or more (e.g., 1, 2, or 3) heavy chain CDRs from the heavy chain of X124-G01 or X115-F02 and one or more (e.g., 1, 2, or 3) light chain CDRs from the corresponding CDRs of the light chain of X124-G01 or X115-F02.

In one embodiment, the HC and LC variable domain sequences are components of the same polypeptide chain.

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein. In one embodiment, the plasma kallikrein binding protein is modified to include, e.g., PEGylation, fusion to serum albumin (e.g., human serum albumin), conjugation to human serum albumin, HESythtion (HESylation utiliseshydroxyethyl starch ("HES") derivatives linked to drug substances in order to modify the drug characteristics or fusion to a unstructured recombinant polymer (URPs).

In another embodiment, the HC and LC variable domain sequences are components of different polypeptide chains.

For example, the protein is an IgG, e.g., IgG1, IgG2, IgG3, or IgG4. The protein can be a soluble Fab (sFab).

In other embodiments, the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human. For example, the protein includes one or more human antibody framework regions, e.g., all human framework regions.

In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions.

In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the protein includes human framework regions, or framework regions that are at least 95, 96, 97, 98, or 99% identical to human framework regions.

In certain embodiments, the protein includes no sequences from mice or rabbits (e.g., is not a murine or rabbit antibody).

In certain embodiments, the protein is capable of binding to a cell or tissue, e.g., that expresses plasma kallikrein.

In one embodiment, protein is physically associated with a nanoparticle, and can be used to guide a nanoparticle to a cell or tissue expressing plasma kallikrein.

In some aspects, the disclosure features a pharmaceutical composition comprising a kallikrein binding protein described herein, e.g., including a pharmaceutically acceptable carrier. In some embodiments, the composition can be at least 10, 20, 30, 50, 75, 85, 90, 95, 98, 99, or 99.9% free of other protein species. In one embodiment, the pharmaceutical composition can be at least 10, 20, 30, 50, 75, 85, 90, 95, 98, 99, or 99.9% free of fragments of the binding protein that do not binding plasma kallikrein (e.g., human plasma kallikrein) or bind plasma kallikrein (e.g., human plasma kallikrein with a Ki, app of 5000 nM or greater.

In some aspects, the disclosure features a method of treating or preventing a plasma kallikrein associated disorder in a subject, the method comprising:

administering an isolated protein (e.g., antibody, e.g., human antibody) that binds plasma kallikrein (e.g., human plasma kallikrein and/or mouse plasma kallikrein) and, e.g., does not bind prekallikrein (e.g., human prekallikrein and/or mouse prekallikrein) to the subject, In some embodiments, the protein binds the same epitope or competes for binding with a protein (e.g., epi-Kal2) and/or a small molecule (e.g., AEBSF) described herein.

In some embodiments, the protein binds the same epitope or competes for binding with a kallikrein binding protein described herein.

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting on ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, and burn injury. In some embodiments, the plasma kallikrein binding protein reduces abberent clotting associated with the contact activation system (i.e., intrinsic activation system) by at least 10% as measured by e.g., an APTT clotting assay. In other embodiments, the plasma kallikrein binding protein reduces abberent clotting associated with the contact activation system by at least 20%, at least 30%, at least 40%, at least 50%, at least 60%, at least 70%, at least 80%, at least 90%, at least 95%, at least 99%, or even 100% (i.e., no detectable abberent clotting).

In some embodiments, the plasma kallikrein binding protein is administered in combination with another treatment for the disorder.

In some embodiments, the protein described herein is selected from the group consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In some embodiments, the plasma kallikrein binding protein competes with or binds the same epitope as X81-B01.

In some embodiments, the plasma kallikrein binding protein competes with or binds the same epitope as X67-D03.

In some embodiments, the plasma kallikrein binding protein competes with or binds to the same epitope as M162-A04 or X115-F02.

In some embodiments, the plasma kallikrein binding protein does not bind prekallikrein (e.g., human prekallikrein and/or mouse prekallikrein), but binds to the active form of plasma kallikrein (e.g., human plasma kallikrein and/or mouse plasma kallikrein).

In certain embodiments, the protein binds at or near the active site of the catalytic domain of plasma kallikrein, or a fragment thereof, or binds an epitope that overlaps with the active site of plasma kallikrein.

In some embodiments, the protein binds to one or more amino acids that form the catalytic triad of plasma kallikrein: His434, Asp483, and/or Ser578 (numbering based on the human sequence).

In some embodiments, the protein binds to one or more amino acids of Ser479, Tyr563, and/or Asp585 (numbering based on the human sequence).

In other embodiments, the protein binds to one or more amino acids of Arg551, Gln553, Tyr555, Thr558, and/or Arg560 (numbering based on the human sequence). In some embodiments, the plasma kallikrein binding protein binds one or more amino acids of: S478, N481, S525, and K526 (numbering based on the human kallikrein sequence).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the plasma kallikrein binding protein has an apparent inhibition constant ($K_{i,app}$) of less than 1000, 500, 100, 10, 5, 1, 0.5, or 0.2 nM.

In one embodiment, the HC and LC variable domain sequences are components of the same polypeptide chain.

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein.

In another embodiment, the HC and LC variable domain sequences are components of different polypeptide chains. For example, the plasma kallikrein binding protein is an IgG, e.g., IgG1, IgG2, IgG3, or IgG4. The plasma kallikrein binding protein can be a soluble Fab (sFab).

In other implementations the plasma kallikrein binding protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the plasma kallikrein binding protein is a human or humanized antibody or is non-immunogenic in a human. For example, the protein includes one or more human antibody framework regions, e.g., all human framework regions.

In one embodiment, the plasma kallikrein binding protein includes a human Fc domain, or an Fc domain that is at least 95, 96, 97, 98, or 99% identical to a human Fc domain.

In one embodiment, the plasma kallikrein binding protein is a primate or primatized antibody or is non-immunogenic in a human. For example, the protein includes one or more primate antibody framework regions, e.g., all primate framework regions.

In one embodiment, the plasma kallikrein binding protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the plasma kallikrein binding protein includes human framework regions, or framework regions that are at least 95, 96, 97, 98, or 99% identical to human framework regions.

In certain embodiments, the plasma kallikrein binding protein includes no sequences from mice or rabbits (e.g., is not a murine or rabbit antibody).

In certain embodiments, the plasma kallikrein binding protein is capable of binding to a cell or tissue, e.g., that expresses plasma kallikrein.

In one embodiment, the plasma kallikrein binding protein is physically associated with a nanoparticle, and can be used to guide a nanoparticle to a cell or tissue expressing plasma kallikrein.

A method of treating or preventing a plasma kallikrein associated disorder in a subject, the method comprising:
administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein (e.g., human plasma kallikrein and/or mouse plasma kallikrein).

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting of ventrical assistance devices or stents, head trauma or peri-tumor brain edema, sepsis, acute middle cerebral artery (MCA) ischemic event (stroke), restenosis (e.g., after angioplasty), systemic lupus erythematosis nephritis, and burn injury. In some embodiments, the plasma kallikrein binding protein reduces abberent clotting associated with the contact activation system (i.e., intrinsic activation system) by at least 10% as measured by e.g., an APTT clotting assay (e.g., by at least 20%, at least 30%, at least 40%, at least 50%, at least 60%, at least 70%, at least 80%, at least 90%, at least 95%, at least 99%, or even 100% (i.e., no detectable abberent clotting)).

In some embodiments, the protein is administered in combination with another treatment for the disorder.

In some embodiments, the protein is administered in combination with a second agent selected from the group consisting of ecallantide, a C1 esterase inhibitor, aprotinin, a bradykinin B2 receptor inhibitor (e.g., icatibant).

In some embodiments, the heavy chain immunoglobulin variable domain sequence comprises one, two, or three (e.g., three) CDR regions from the heavy chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04, and/or the light chain immunoglobulin variable domain sequence comprises one, two, or three (e.g., three) CDR regions from the light chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 (respectively).

In some embodiments, the protein inhibits plasma kallikrein.

In some embodiments, the one, two, or three (e.g., three) CDR regions from the heavy chain variable domain are from X81-B01 and/or the one, two, or three (e.g., three) CDR regions from the light chain variable domain are from X81-B01.

In some embodiments, the one, two, or three (e.g., three) CDR regions from the heavy chain variable domain are from X67-D03 and/or the one, two, or three (e.g., three) CDR regions from the light chain variable domain are from X67-D03.

In some embodiments, the one, two, or three (e.g., three) CDR regions from the heavy chain variable domain are from M162-A04 and/or the one, two, or three (e.g., three) CDR regions from the light chain variable domain are from M162-A04.

In some embodiments, the one, two, or three (e.g., three) CDR regions from the heavy chain variable domain are from X115-F02 and/or the one, two, or three (e.g., three) CDR regions from the light chain variable domain are from X115-F02.

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the heavy chain immunoglobulin variable domain sequence comprises the heavy chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04, and/or the light chain immunoglobulin variable domain sequence comprises the light chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In some embodiments, the heavy chain immunoglobulin variable domain sequence comprises the heavy chain variable domain of X81-B01, and/or the light chain immunoglobulin variable domain sequence comprises the light chain variable domain of X81-B01.

In some embodiments, the heavy chain immunoglobulin variable domain sequence comprises the heavy chain variable domain of X67-D03, and/or the light chain immunoglobulin variable domain sequence comprises the light chain variable domain of X67-D03.

In some embodiments, the protein comprises the heavy chain of a protein described herein, and/or the light chain of a protein described herein.

In some embodiments, the protein comprises the heavy chain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04, and/or the light chain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 (respectively).

In some embodiments, the protein comprises the heavy chain of X81-B01, and/or the light chain of X81-B01.

In some embodiments, the protein comprises the heavy chain of X67-D03, and/or the light chain of X67-D03.

In some embodiments, the protein comprises the heavy chain of M162-A04, and/or the light chain of M162-A04.

In some embodiments, the protein comprises the heavy chain of X115-F02 or X124-G01, and/or the light chain of X115-F02 or X124-G01.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the protein includes one or more of the following characteristics: (a) a human CDR or human framework region; (b) the HC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a LC variable domain described herein; (d) the LC immunoglobulin variable domain sequence is at least 85, 88, 89, 90, 91, 92, 93, 94, 95, 96, 97, 98, 99, or 100% identical to a LC variable domain described herein (e.g., overall or in framework regions or CDRs); (e) the HC immunoglobulin variable domain sequence is at least 85, 88, 89, 90, 91, 92, 93, 94, 95, 96, 97, 98, 99, or 100% identical to a HC variable domain described herein (e.g., overall or in framework regions or CDRs); (f) the protein binds an epitope bound by a protein described herein, or competes for binding with a protein described herein; and (g) a primate CDR or primate framework region.

In some embodiments, the protein has an apparent inhibition constant ($K_{i,app}$) of less than 1000, 500, 100, 10, 5, 1, 0.5 or 0.2 nM.

In some embodiments, the antibody does not bind prekallikrein (e.g., human prekallikrein), but binds to the active form of plasma kallikrein (e.g., human plasma kallikrein).

In a preferred embodiment, the protein is an antibody (e.g., a human antibody) having the light and heavy chains of antibodies selected from the group consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having the heavy chain of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having the light chain of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having light and heavy antibody variable regions of an antibody selected from the group consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having a heavy chain antibody variable region of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having a light chain antibody variable region of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) light chain CDRs selected from the corresponding CDRs of the group of light chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 and one or more (e.g., 1, 2, or 3) light chain CDRs selected from the corresponding CDRs of the group of light chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 (respectively).

In a preferred embodiment, the protein is an antibody (e.g., a human antibody) having the light and heavy chains of X81-B01.

In a preferred embodiment, the protein is an antibody (e.g., a human antibody) having the heavy chain of X81-B01.

In a preferred embodiment, the protein is an antibody (e.g., a human antibody) having the light chain of X81-B01.

In a preferred embodiment, the protein is an antibody (e.g., a human antibody) having light and heavy antibody variable regions of an antibody selected from X81-B01.

In a preferred embodiment, the protein is an antibody (e.g., a human antibody) having a heavy chain antibody variable region of X81-B01.

In a preferred embodiment, the protein is an antibody (e.g., a human antibody) having a light chain antibody variable region of X81-B01.

In a preferred embodiment, the protein is an antibody (e.g., a human antibody) having one or more (e.g., 1, 2, or 3) heavy chain CDRs from the corresponding CDRs of the heavy chain of X81-B01.

In a preferred embodiment, the protein is an antibody (e.g., a human antibody) having one or more (e.g., 1, 2, or 3) light chain CDRs from the corresponding CDRs of the light chain of X81-B01.

In a preferred embodiment, the protein is an antibody (e.g., a human antibody) having one or more (e.g., 1, 2, or 3) heavy chain CDRs from the heavy chain of X81-B01 and one or more (e.g., 1, 2, or 3) light chain CDRs from the corresponding CDRs of the light chain of X81-B01.

In a preferred embodiment, the protein is an antibody (e.g., a human antibody) having the light and heavy chains of X67-D03.

In a preferred embodiment, the protein is an antibody (e.g., a human antibody) having the heavy chain of X67-D03.

In a preferred embodiment, the protein is an antibody (e.g., a human antibody) having the light chain of X67-D03.

In a preferred embodiment, the protein is an antibody (e.g., a human antibody) having light and heavy antibody variable regions of an antibody selected from X67-D03.

In a preferred embodiment, the protein is an antibody (e.g., a human antibody) having a heavy chain antibody variable region of X67-D03.

In a preferred embodiment, the protein is an antibody (e.g., a human antibody) having a light chain antibody variable region of X67-D03.

In a preferred embodiment, the protein is an antibody (e.g., a human antibody) having one or more (e.g., 1, 2, or 3) heavy chain CDRs from the corresponding CDRs of the heavy chain of X67-D03.

In a preferred embodiment, the protein is an antibody (e.g., a human antibody) having one or more (e.g., 1, 2, or 3) light chain CDRs from the corresponding CDRs of the light chain of X67-D03.

In a preferred embodiment, the protein is an antibody (e.g., a human antibody) having one or more (e.g., 1, 2, or 3) heavy chain CDRs from the heavy chain of X67-D03 and one or more (e.g., 1, 2, or 3) light chain CDRs from the corresponding CDRs of the light chain of X67-D03.

In a preferred embodiment, the protein is an antibody (e.g., a human antibody) having the light and heavy chains of X115-F02 or X124-G01.

In a preferred embodiment, the protein is an antibody (e.g., a human antibody) having the heavy chain of X115-F02 or X124-G01.

In a preferred embodiment, the protein is an antibody (e.g., a human antibody) having the light chain of X115-F02 or X124-G01.

In a preferred embodiment, the protein is an antibody (e.g., a human antibody) having light and heavy antibody variable regions of an antibody selected from X115-F02 or X124-G01.

In a preferred embodiment, the protein is an antibody (e.g., a human antibody) having a heavy chain antibody variable region of X115-F02 or X124-G01.

In a preferred embodiment, the protein is an antibody (e.g., a human antibody) having a light chain antibody variable region of X115-F02 or X124-G01.

In a preferred embodiment, the protein is an antibody (e.g., a human antibody) having one or more (e.g., 1, 2, or 3) heavy chain CDRs from the corresponding CDRs of the heavy chain of X115-F02 or X124-G01.

In a preferred embodiment, the protein is an antibody (e.g., a human antibody) having one or more (e.g., 1, 2, or 3) light chain CDRs from the corresponding CDRs of the light chain of X115-F02 or X124-G01.

In a preferred embodiment, the protein is an antibody (e.g., a human antibody) having one or more (e.g., 1, 2, or 3) heavy chain CDRs from the heavy chain of X115-F02 or X124-G01 and one or more (e.g., 1, 2, or 3) light chain CDRs from the corresponding CDRs of the light chain of X115-F02 or X124-G01.

In one embodiment, the HC and LC variable domain sequences are components of the same polypeptide chain.

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein.

In another embodiment, the HC and LC variable domain sequences are components of different polypeptide chains. For example, the protein is an IgG, e.g., IgG1, IgG2, IgG3, or IgG4. The protein can be a soluble Fab (sFab).

In other implementations the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human. For example, the protein includes one or more human antibody framework regions, e.g., all human framework regions.

In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions.

In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the protein includes human framework regions, or framework regions that are at least 95, 96, 97, 98, or 99% identical to human framework regions.

In certain embodiments, the protein includes no sequences from mice or rabbits (e.g., is not a murine or rabbit antibody).

In certain embodiments, the protein is capable of binding to a cell or tissue, e.g., that expresses plasma kallikrein.

In one embodiment, protein is physically associated with a nanoparticle, and can be used to guide a nanoparticle to a cell or tissue expressing plasma kallikrein.

In some aspects, the disclosure features a method of promoting wound healing in a subject, the method comprising:

administering an isolated protein (e.g., antibody, e.g., human antibody) that binds plasma kallikrein (e.g., human plasma kallikrein and/or mouse plasma kallikrein) and, e.g., does not bind prekallikrein (e.g., human prekallikrein and/or mouse prekallikrein) to the subject.

In some embodiments, the protein binds the same epitope or competes for binding with a kallikrein binding protein described herein. In some embodiments, the protein binds the same epitope or competes for binding with a protein (e.g., epi-Kal2) and/or a small molecule (e.g., AEBSF) described herein.

In some embodiments, the plasma kallikrein binding protein is administered in combination with another treatment for wound healing.

In some embodiments, the protein described herein is selected from the group consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In some embodiments, the plasma kallikrein binding protein competes with or binds the same epitope as X81-B01.

In some embodiments, the plasma kallikrein binding protein competes with or binds the same epitope as X67-D03.

In some embodiments, the plasma kallikrein binding protein competes with or binds the same epitope as M162-A04.

In some embodiments, the plasma kallikrein binding protein competes with or binds the same epitope as X115-F02 or X124-G01.

In some embodiments, the plasma kallikrein binding protein does not bind prekallikrein (e.g., human prekallikrein), but binds to the active form of plasma kallikrein (e.g., human plasma kallikrein).

In certain embodiments, the protein binds at or near the active site of the catalytic domain of plasma kallikrein, or a fragment thereof, or binds an epitope that overlaps with the active site of plasma kallikrein.

In some embodiments, the protein binds to one or more amino acids that form the catalytic triad of plasma kallikrein: His434, Asp483, and/or Ser578 (numbering based on the human sequence). In other embodiments, the protein binds to one or more amino acids that form a region for substrate recognition: Arg551, Gln553, Tyr555, Thr558, and/or Arg560 (numbering based on the human sequence). In some embodiments, the plasma kallikrein binding protein binds one or more amino acids of: S478, N481, S525, and K526 (numbering based on the human kallikrein sequence).

In some embodiments, the protein binds to one or more amino acids of Ser479, Tyr563, and/or Asp585 (numbering based on the human sequence).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the plasma kallikrein binding protein has an apparent inhibition constant ($K_{i,app}$) of less than 1000, 500, 100, 10, 5, 1, 0.5 or 0.2 nM.

In one embodiment, the HC and LC variable domain sequences are components of the same polypeptide chain.

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein.

In another embodiment, the HC and LC variable domain sequences are components of different polypeptide chains. For example, the plasma kallikrein binding protein is an IgG, e.g., IgG1, IgG2, IgG3, or IgG4. The plasma kallikrein binding protein can be a soluble Fab (sFab).

In other implementations the plasma kallikrein binding protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the plasma kallikrein binding protein is a human or humanized antibody or is non-immunogenic in a human. For example, the protein includes one or more human antibody framework regions, e.g., all human framework regions.

In one embodiment, the plasma kallikrein binding protein includes a human Fc domain, or an Fc domain that is at least 95, 96, 97, 98, or 99% identical to a human Fc domain.

In one embodiment, the plasma kallikrein binding protein is a primate or primatized antibody or is non-immunogenic in a human. For example, the protein includes one or more primate antibody framework regions, e.g., all primate framework regions.

In one embodiment, the plasma kallikrein binding protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the plasma kallikrein binding protein includes human framework regions, or framework regions that are at least 95, 96, 97, 98, or 99% identical to human framework regions.

In certain embodiments, the plasma kallikrein binding protein includes no sequences from mice or rabbits (e.g., is not a murine or rabbit antibody).

In certain embodiments, the protein is capable of binding to a cell or tissue, e.g., that expresses plasma kallikrein.

In one embodiment, the plasma kallikrein binding protein is physically associated with a nanoparticle, and can be used to guide a nanoparticle to a cell or tissue expressing plasma kallikrein.

In some aspects, the disclosure features a method promoting wound healing in a subject, the method comprising:
administering an isolated protein (e.g., antibody, e.g., human antibody) comprising a heavy chain immunoglobulin variable domain sequence and a light chain immunoglobulin variable domain sequence to the subject, wherein:
the heavy chain immunoglobulin variable domain sequence comprises one, two, or three (e.g., three) CDR regions from the heavy chain variable domain of a protein described herein, and/or
the light chain immunoglobulin variable domain sequence comprises one, two, or three (e.g., three) CDR regions from the light chain variable domain of a protein described herein,
wherein the protein binds to plasma kallikrein.

In some embodiments, the protein is administered in combination with another treatment for wound healing.

In some embodiments, the heavy chain immunoglobulin variable domain sequence comprises one, two, or three (e.g., three) CDR regions from the heavy chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04, and/or the light chain immunoglobulin variable domain sequence comprises one, two, or three (e.g., three) CDR regions from the light chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 (respectively).

In some embodiments, the protein inhibits plasma kallikrein.

In some embodiments, the one, two, or three (e.g., three) CDR regions from the heavy chain variable domain are from X81-B01 and/or the one, two, or three (e.g., three) CDR regions from the light chain variable domain are from X81-B01.

In some embodiments, the one, two, or three (e.g., three) CDR regions from the heavy chain variable domain are from X67-D03 and/or the one, two, or three (e.g., three) CDR regions from the light chain variable domain are from X67-D03.

In some embodiments, the one, two, or three (e.g., three) CDR regions from the heavy chain variable domain are from M162-A04 and/or the one, two, or three (e.g., three) CDR regions from the light chain variable domain are from M162-A04.

In some embodiments, the one, two, or three (e.g., three) CDR regions from the heavy chain variable domain are from M199-A08 and/or the one, two, or three (e.g., three) CDR regions from the light chain variable domain are from M199-A08.

In some embodiments, the one, two, or three (e.g., three) CDR regions from the heavy chain variable domain are from X115-F02 or X124-G01 and/or the one, two, or three (e.g., three) CDR regions from the light chain variable domain are from X115-F02 or X124-G01.

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the heavy chain immunoglobulin variable domain sequence comprises the heavy chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04, and/or the light chain immunoglobulin variable domain sequence comprises the light chain variable domain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 (respectively).

In some embodiments, the heavy chain immunoglobulin variable domain sequence comprises the heavy chain variable domain of X81-B01, and/or the light chain immunoglobulin variable domain sequence comprises the light chain variable domain of X81-B01.

In some embodiments, the heavy chain immunoglobulin variable domain sequence comprises the heavy chain variable domain of X67-D03, and/or the light chain immunoglobulin variable domain sequence comprises the light chain variable domain of X67-D03.

In some embodiments, the protein comprises the heavy chain of a protein described herein, and/or the light chain of a protein described herein.

In some embodiments, the protein comprises the heavy chain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04, and/or the light chain of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 (respectively).

In some embodiments, the protein comprises the heavy chain of X81-B01, and/or the light chain of X81-B01.

In some embodiments, the protein comprises the heavy chain of X67-D03, and/or the light chain of X67-D03.

In some embodiments, the protein comprises the heavy chain of M162-A04, and/or the light chain of M162-A04.

In some embodiments, the protein comprises the heavy chain of X115-F02 or X124-G01, and/or the light chain of X115-F02 or X124-G01.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the plasma kallikrein binding protein decreases Factor XIIa and/or bradykinin production by greater than about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, or about 95% as compared to a standard, e.g., the Factor XIIa and/or bradykinin production under the same conditions but in the absence of the protein.

In some embodiments, the protein includes one or more of the following characteristics: (a) a human CDR or human framework region; (b) the HC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a LC variable domain described herein; (d) the LC immunoglobulin variable domain sequence is at least 85, 88, 89, 90, 91, 92, 93, 94, 95, 96, 97, 98, 99, or 100% identical to a LC variable domain described herein (e.g., overall or in framework regions or CDRs); (e) the HC immunoglobulin variable domain sequence is at least 85, 88, 89, 90, 91, 92, 93, 94, 95, 96, 97, 98, 99, or 100% identical to a HC variable domain described herein (e.g., overall or in framework regions or CDRs); (f) the protein binds an epitope bound by a protein described herein, or competes for binding with a protein described herein; and (g) a primate CDR or primate framework region.

In some embodiments, the protein has an apparent inhibition constant ($K_{i,app}$) of less than 1000, 500, 100, 5, 1, 0.5 or 0.2 nM.

In some embodiments, the antibody does not bind prekallikrein (e.g., human prekallikrein and/or murine prekallikrein), but binds to the active form of plasma kallikrein (e.g., human plasma kallikrein and/or murine plasma kallikrein).

In a preferred embodiment, the protein is an antibody (e.g., a human antibody) having the light and heavy chains of antibodies selected from the group consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X-124-G01, X115-G04, M29-D09, M145-D11, M06-D09 and M35-G04.

In a preferred embodiment, the protein is an antibody (e.g., a human antibody) having the heavy chain of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having the light chain of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having light and heavy antibody variable regions of an antibody selected from the group consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having a heavy chain antibody variable region of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having a light chain antibody variable region of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) light chain CDRs selected from the corresponding CDRs of the group of light chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 and one or more (e.g., 1, 2, or 3) light chain CDRs selected from the corresponding CDRs of the group of light chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04 (respectively).

In a preferred embodiment, the protein is an antibody (e.g., a human antibody) having the light and heavy chains of X81-B01.

In a preferred embodiment, the protein is an antibody (e.g., a human antibody) having the heavy chain of X81-B01.

In a preferred embodiment, the protein is an antibody (e.g., a human antibody) having the light chain of X81-B01.

In a preferred embodiment, the protein is an antibody (e.g., a human antibody) having light and heavy antibody variable regions of an antibody selected from X81-B01.

In a preferred embodiment, the protein is an antibody (e.g., a human antibody) having a heavy chain antibody variable region of X81-B01.

In a preferred embodiment, the protein is an antibody (e.g., a human antibody) having a light chain antibody variable region of X81-B01.

In a preferred embodiment, the protein is an antibody (e.g., a human antibody) having one or more (e.g., 1, 2, or 3) heavy chain CDRs from the corresponding CDRs of the heavy chain of X81-B01.

In a preferred embodiment, the protein is an antibody (e.g., a human antibody) having one or more (e.g., 1, 2, or 3) light chain CDRs from the corresponding CDRs of the light chain of X81-B01.

In a preferred embodiment, the protein is an antibody (e.g., a human antibody) having one or more (e.g., 1, 2, or 3) heavy chain CDRs from the heavy chain of X81-B01 and one or more (e.g., 1, 2, or 3) light chain CDRs from the corresponding CDRs of the light chain of X81-B01.

In a preferred embodiment, the protein is an antibody (e.g., a human antibody) having the light and heavy chains of X67-D03.

In a preferred embodiment, the protein is an antibody (e.g., a human antibody) having the heavy chain of X67-D03.

In a preferred embodiment, the protein is an antibody (e.g., a human antibody) having the light chain of X67-D03.

In a preferred embodiment, the protein is an antibody (e.g., a human antibody) having light and heavy antibody variable regions of an antibody selected from X67-D03.

In a preferred embodiment, the protein is an antibody (e.g., a human antibody) having a heavy chain antibody variable region of X67-D03.

In a preferred embodiment, the protein is an antibody (e.g., a human antibody) having a light chain antibody variable region of X67-D03.

In a preferred embodiment, the protein is an antibody (e.g., a human antibody) having one or more (e.g., 1, 2, or 3) heavy chain CDRs from the corresponding CDRs of the heavy chain of X67-D03.

In a preferred embodiment, the protein is an antibody (e.g., a human antibody) having one or more (e.g., 1, 2, or 3) light chain CDRs from the corresponding CDRs of the light chain of X67-D03.

In a preferred embodiment, the protein is an antibody (e.g., a human antibody) having one or more (e.g., 1, 2, or 3) heavy chain CDRs from the heavy chain of X67-D03 and one or more (e.g., 1, 2, or 3) light chain CDRs from the corresponding CDRs of the light chain of X67-D03.

In a preferred embodiment, the protein is an antibody (e.g., a human antibody) having the light and heavy chains of X115-F02 or X124-G01.

In a preferred embodiment, the protein is an antibody (e.g., a human antibody) having the heavy chain of X115-F02 or X124-G01.

In a preferred embodiment, the protein is an antibody (e.g., a human antibody) having the light chain of X115-F02 or X124-G01.

In a preferred embodiment, the protein is an antibody (e.g., a human antibody) having light and heavy antibody variable regions of an antibody selected from X115-F02 or X124-G01.

In a preferred embodiment, the protein is an antibody (e.g., a human antibody) having a heavy chain antibody variable region of X115-F02 or X124-G01.

In a preferred embodiment, the protein is an antibody (e.g., a human antibody) having a light chain antibody variable region of X115-F02 or X124-G01.

In a preferred embodiment, the protein is an antibody (e.g., a human antibody) having one or more (e.g., 1, 2, or 3) heavy chain CDRs from the corresponding CDRs of the heavy chain of X115-F02 or X124-G01.

In a preferred embodiment, the protein is an antibody (e.g., a human antibody) having one or more (e.g., 1, 2, or 3) light chain CDRs from the corresponding CDRs of the light chain of X115-F02 or X124-G01.

In a preferred embodiment, the protein is an antibody (e.g., a human antibody) having one or more (e.g., 1, 2, or 3) heavy chain CDRs from the heavy chain of X115-F02 or X124-G01 and one or more (e.g., 1, 2, or 3) light chain CDRs from the corresponding CDRs of the light chain of X115-F02 or X124-G01.

In one embodiment, the HC and LC variable domain sequences are components of the same polypeptide chain.

In some embodiments, the plasma kallikrein binding protein has a serum residence time of 1 week, 2 weeks, 3 weeks, 4 weeks, 5 weeks or more, in vivo, e.g., in humans. In one embodiment, the plasma kallikrein binding protein is an IgG, e.g., an IgG1, IgG2, IgG3 or IgG4, that has a serum residence time of 1 week, 2 weeks, 3 weeks, 4 weeks, 5 weeks or more in vivo, e.g., in humans.

In some embodiments, the plasma kallikrein binding protein is physically associated with a moiety that improves serum residence time, e.g., a moiety described herein.

In another embodiment, the HC and LC variable domain sequences are components of different polypeptide chains. For example, the protein is an IgG, e.g., IgG1, IgG2, IgG3, or IgG4. The protein can be a soluble Fab (sFab).

In other implementations the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human. For example, the protein includes one or more human antibody framework regions, e.g., all human framework regions.

In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions.

In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

In one embodiment, the protein includes human framework regions, or framework regions that are at least 95, 96, 97, 98, or 99% identical to human framework regions.

In certain embodiments, the protein includes no sequences from mice or rabbits (e.g., is not a murine or rabbit antibody).

In certain embodiments, the protein is capable of binding to a cell or tissue, e.g., that expresses plasma kallikrein.

In one embodiment, protein is physically associated with a nanoparticle, and can be used to guide a nanoparticle to a cell or tissue expressing plasma kallikrein.

In some aspects, the disclosure features a method of treating or preventing rheumatoid arthritis in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for rheumatoid arthritis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing gout in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein,
wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for gout.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing intestinal bowel disease in a subject, the method comprising:
administering an isolated protein (e.g., antibody, e.g., human antibody) comprising a heavy chain immunoglobulin variable domain sequence and a light chain immunoglobulin variable domain sequence to the subject, wherein:
the heavy chain immunoglobulin variable domain sequence comprises one, two, or three (e.g., three) CDR regions from the heavy chain variable domain of a protein described herein, and/or
the light chain immunoglobulin variable domain sequence comprises one, two, or three (e.g., three) CDR regions from the light chain variable domain of a protein described herein,
wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for intestinal bowel disease.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing oral mucositis in a subject, the method comprising:
administering an isolated protein (e.g., antibody, e.g., human antibody) comprising a heavy chain immunoglobulin variable domain sequence and a light chain immunoglobulin variable domain sequence to the subject, wherein:
the heavy chain immunoglobulin variable domain sequence comprises one, two, or three (e.g., three) CDR regions from the heavy chain variable domain of a protein described herein, and/or
the light chain immunoglobulin variable domain sequence comprises one, two, or three (e.g., three) CDR regions from the light chain variable domain of a protein described herein,
wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for oral mucositis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing neuropathic pain in a subject, the method comprising:
administering an isolated protein (e.g., antibody, e.g., human antibody) comprising a heavy chain immunoglobulin variable domain sequence and a light chain immunoglobulin variable domain sequence to the subject, wherein:
the heavy chain immunoglobulin variable domain sequence comprises one, two, or three (e.g., three) CDR regions from the heavy chain variable domain of a protein described herein, and/or
the light chain immunoglobulin variable domain sequence comprises one, two, or three (e.g., three) CDR regions from the light chain variable domain of a protein described herein,
wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for neuropathic pain.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing inflammatory pain in a subject, the method comprising:
administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for inflammatory pain.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing spinal stenosis-degenerative spine disease in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for spinal stenosis-degenerative spine disease.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing arterial or venous thrombosis in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for arterial or venous thrombosis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing post operative ileus in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for post operative ileus.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing aortic aneurysm in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein,
wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for aortic aneurysm.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing osteoarthritis in a subject, the method comprising:
administering an isolated protein (e.g., antibody, e.g., human antibody) comprising a heavy chain immunoglobulin variable domain sequence and a light chain immunoglobulin variable domain sequence to the subject, wherein:
the heavy chain immunoglobulin variable domain sequence comprises one, two, or three (e.g., three) CDR regions from the heavy chain variable domain of a protein described herein, and/or
the light chain immunoglobulin variable domain sequence comprises one, two, or three (e.g., three) CDR regions from the light chain variable domain of a protein described herein,
wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for osteoarthritis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing vasculitis in a subject, the method comprising:
administering an isolated protein (e.g., antibody, e.g., human antibody) comprising a heavy chain immunoglobulin variable domain sequence and a light chain immunoglobulin variable domain sequence to the subject, wherein:
the heavy chain immunoglobulin variable domain sequence comprises one, two, or three (e.g., three) CDR regions from the heavy chain variable domain of a protein described herein, and/or
the light chain immunoglobulin variable domain sequence comprises one, two, or three (e.g., three) CDR regions from the light chain variable domain of a protein described herein,
wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for vasculitis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing head trauma or peri-tumor brain edema in a subject, the method comprising:
administering an isolated protein (e.g., antibody, e.g., human antibody) comprising a heavy chain immunoglobulin variable domain sequence and a light chain immunoglobulin variable domain sequence to the subject, wherein:
the heavy chain immunoglobulin variable domain sequence comprises one, two, or three (e.g., three) CDR regions from the heavy chain variable domain of a protein described herein, and/or
the light chain immunoglobulin variable domain sequence comprises one, two, or three (e.g., three) CDR regions from the light chain variable domain of a protein described herein,
wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for head trauma or peri-tumor brain edema.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing sepsis in a subject, the method comprising:
administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for sepsis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing acute middle cerebral artery (MCA) ischemic event (stroke) in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for acute middle cerebral artery (MCA) ischemic event (stroke).

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing restenosis (e.g., after angioplasty) in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for restenosis (e.g., after angioplasty).

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing systemic lupus erythematosis nephritis in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for systemic lupus erythematosis nephritis.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of treating or preventing burn injury in a subject, the method comprising:

administering an isolated protein (e.g., antibody, e.g., human antibody) comprising a heavy chain immunoglobulin variable domain sequence and a light chain immunoglobulin variable domain sequence to the subject, wherein:

the heavy chain immunoglobulin variable domain sequence comprises one, two, or three (e.g., three) CDR regions from the heavy chain variable domain of a protein described herein, and/or the light chain immunoglobulin variable domain sequence comprises one, two, or three (e.g., three) CDR regions from the light chain variable domain of a protein described herein, wherein the protein binds to plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the protein is administered in combination with another treatment for burn injury.

In some embodiments, the protein inhibits plasma kallikrein (e.g., human plasma kallikrein and/or murine plasma kallikrein).

In some embodiments, the heavy chain immunoglobulin variable domain sequence comprises the heavy chain variable domain of a protein described herein, and/or the light chain immunoglobulin variable domain sequence comprises the light chain variable domain of a protein described herein.

In some embodiments, the protein comprises the heavy chain of a protein described herein, and/or the light chain of a protein described herein.

In some aspects, the disclosure features a method of detecting plasma kallikrein in a sample, the method comprising: contacting the sample with a plasma kallikrein binding protein (e.g., a plasma kallikrein binding protein described herein); and detecting an interaction between the protein and the plasma kallikrein, if present.

In some embodiments, the protein includes a detectable label.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein). In some embodiments, the plasma kallikrein binding protein binds prekallikrein (e.g., human prekallikrein and/or murine prekallikrein) and the active form of plasma kallikrein (e.g., human plasma kallikrein and/or murine plasma kallikrein).

In some aspects, the disclosure features a method of detecting plasma kallikrein in a subject, the method comprising: administering a plasma kallikrein binding protein (e.g., a plasma kallikrein binding protein described herein) to a subject; and detecting an interaction between the protein and the plasma kallikrein in the subject, if present. For example, the detecting comprises imaging the subject.

In some embodiments, the protein further includes a detectable label.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein). In some embodiments, the plasma kallikrein binding protein binds prekallikrein (e.g., human prekallikrein and/or murine prekallikrein) and the active form of plasma kallikrein (e.g., human plasma kallikrein and/or murine plasma kallikrein).

In some aspects, the disclosure features a method of modulating plasma kallikrein activity, e.g., in a method of treating or preventing a plasma kallikrein associated disorder. The method includes: contacting plasma kallikrein with a plasma kallikrein binding protein (e.g., a plasma kallikrein binding protein described herein) (e.g., in a human subject), thereby modulating plasma kallikrein activity.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis/vasculitis, and burn injury.

In some embodiments, the plasma kallikrein binding protein reduces abberent clotting associated with the contact activation system (i.e., intrinsic activation system) by at least 10% as measured by e.g., an APTT clotting assay. In other embodiments, the plasma kallikrein binding protein reduces abberent clotting associated with the contact activation system by at least 20%, at least 30%, at least 40%, at least 50%, at least 60%, at least 70%, at least 80%, at least 90%, at least 95%, at least 99%, or even 100% (i.e., no detectable abberent clotting).

In some aspects, the disclosure features a method of treating a plasma kallikrein associated disorder, the method comprising administering, to a subject, a plasma kallikrein binding protein (e.g., a plasma kallikrein binding protein described herein) in an amount sufficient to treat a plasma kallikrein associated disorder in the subject. The method can further include providing to the subject a second therapy that is therapy for the plasma kallikrein associated disorder, e.g., as described herein.

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis/vasculitis, and burn injury.

In some aspects, the disclosure features a method of imaging a subject. The method includes administering a plasma kallikrein binding protein (e.g., a plasma kallikrein binding protein described herein) to the subject, and e.g., detecting an interaction between the protein and the plasma kallikrein in the subject, if present.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein). In some embodiments, the plasma kallikrein binding protein binds prekallikrein (e.g., human prekallikrein and/or murine prekallikrein) and the active form of plasma kallikrein (e.g., human plasma kallikrein and/or murine plasma kallikrein).

In some embodiments, the protein does not inhibit plasma kallikrein activity.

In some embodiments, the protein inhibits plasma kallikrein activity (e.g., human plasma kallikrein and/or murine plasma kallikrein).

In some embodiments, the plasma kallikrein binding protein may include a detectable label (e.g., a radionuclide or an MRI-detectable label).

In some embodiments, the subject has or is suspected of having a plasma kallikrein associated disorder. The method is useful, e.g., for diagnosis of a plasma kallikrein associated disorder.

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, and burn injury.

In some embodiments, the plasma kallikrein binding protein reduces abberent clotting associated with the contact activation system (i.e., intrinsic activation system) by at least 10% as measured by e.g., an APTT clotting assay (e.g., by at least 20%, at least 30%, at least 40%, at least 50%, at least 60%, at least 70%, at least 80%, at least 90%, at least 95%, at least 99%, or even 100% (i.e., no detectable abberent clotting)).

In some aspects, the disclosure features a method of imaging plasma kallikrein, e.g., in a subject or sample (e.g., biopsy sample). The method includes administering a plasma kallikrein binding protein (e.g., a plasma kallikrein binding protein described herein), e.g., to the subject or the sample, and detecting an interaction between the protein and the plasma kallikrein, if present.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein). In some embodiments, the plasma kallikrein binding protein binds prekallikrein (e.g., human prekallikrein and/or murine prekallikrein) and the active form of plasma kallikrein (e.g., human plasma kallikrein and/or murine plasma kallikrein).

In some embodiments, the protein does not inhibit plasma kallikrein activity.

In some embodiments, the protein inhibits plasma kallikrein activity (e.g., human plasma kallikrein and/or murine plasma kallikrein).

In some embodiments, the plasma kallikrein binding protein may include a detectable label (e.g., a radionuclide or an MRI-detectable label).

In some embodiments, the subject has or is suspected of having a plasma kallikrein associated disorder. The method is useful, e.g., for diagnosis of a plasma kallikrein associated disorder.

In some embodiments, the plasma kallikrein associated disorder is selected from the group consisting of rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, and burn injury.

In some embodiments, the plasma kallikrein binding protein reduces abberent clotting associated with the contact activation system (i.e., intrinsic activation system) by at least 10% as measured by e.g., an APTT clotting assay (e.g., by at least 20%, at least 30%, at least 40%, at least 50%, at least 60%, at least 70%, at least 80%, at least 90%, at least 95%, at least 99%, or even 100% (i.e., no detectable abberent clotting)).

In one aspect, the disclosure features the use of a plasma kallikrein binding protein described herein for the treatment of a disorder described herein, e.g., rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, or burn injury; or to promote wound healing.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein). In some embodiments, the plasma kallikrein binding protein binds prekallikrein (e.g., human prekallikrein and/or murine prekallikrein) and the active form of plasma kallikrein (e.g., human plasma kallikrein and/or murine plasma kallikrein).

In one aspect, the disclosure features the use of a plasma kallikrein binding protein described herein for the manufacture of a medicament for the treatment of a disorder described herein, e.g., rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, or burn injury; or for the manufacture of a medicament for wound healing.

In some embodiments, the plasma kallikrein binding protein reduces abberent clotting associated with the contact activation system (i.e., intrinsic activation system) by at least 10% as measured by e.g., an APTT clotting assay (e.g., by at least 20%, at least 30%, at least 40%, at least 50%, at least 60%, at least 70%, at least 80%, at least 90%, at least 95%, at least 99%, or even 100% (i.e., no detectable abberent clotting)).

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine plasma kallikrein).

The details of one or more embodiments of the invention are set forth in the accompanying drawings and the description below. Other features, objects, and advantages of the invention will be apparent from the description and drawings, and from the claims.

The contents of all cited references including literature references, issued patents, published or non-published patent applications cited throughout this application as well as those listed below are hereby expressly incorporated by reference in their entireties. In case of conflict, the present application, including any definitions herein, will control.

BRIEF DESCRIPTION OF DRAWINGS

FIG. 4 depicts the alignment of the light chain DNA sequence of nongermlined (X63-G06) (SEQ ID NO: 2558) and germlined, codon optimized (X81-B01) (SEQ ID NO: 2559) versions of the same antibody discovered using ROLIC affinity maturation. Positions indicated with an asterisk (*) are conserved, whereas blank spaces correspond to bases changed in X81-B01 due to either codon optimization or germlining.

FIG. 5 depicts the alignment of the light chain amino acid sequence of nongermlined (X63-G06) (SEQ ID NO: 2560) and germlined, codon optimized (X81-B01) (SEQ ID NO: 2561) versions of the same antibody discovered using ROLIC affinity maturation. Positions indicated with an asterisk (*) are conserved, whereas blank spaces correspond to amino acids changed in X81-B01 due to germlining. A total of 11 amino acids differ between the nongermlined (X63-G06) and germlined, codon optimized antibody (X81-B01).

FIG. 6 depicts the alignment of the heavy chain DNA sequence of nongermlined (X63-G06) (SEQ ID NO: 2563) and germlined, codon optimized (X81-B01) (SEQ ID NO: 2562) versions of the same antibody discovered using ROLIC affinity maturation. Positions indicated with an asterisk (*) are conserved, whereas blank spaces correspond to DNA bases changed in X81-B01 due to codon optimization.

FIG. 7 depicts the alignment of the heavy chain amino acid sequence of nongermlined (X63-G06) (SEQ ID NO: 2565) and germlined, codon optimized (X81-B01) (SEQ ID NO: 2564) versions of the same antibody discovered using ROLIC affinity maturation. Positions indicated with an asterisk (*) are conserved. The two antibodies have the same amino acid sequence in the heavy chain.

FIGS. 10A-10C depict ClustalW alignment of pKal sequences from different species (SEQ ID NOS 2573-2580, respectively, in order of appearance). Positions indicated by a "*" are conserved positions between, whereas positions indicated ":" indicate conservative substitutions between species. Positions indicated by a "." have nonconservative substitutions in some species. Stretches of amino acids indicated by the symbol "@" were shown to be highly solvent exposed by solvent accessible surface area calculation. Stretches of amino acids indicated by a "+" were identified as potential epitopes of antibodies listed in Table 12 Amino acids highlighted in grey were found by solvent accessible surface area calculation to be buried when complexed with a Kunitz domain active site inhibitor. The underlined positions are the amino acids that form the catalytic triad (His434, Asp483, and Ser578, numbering based on the human sequence).

DETAILED DESCRIPTION

Definitions

Figure 1:
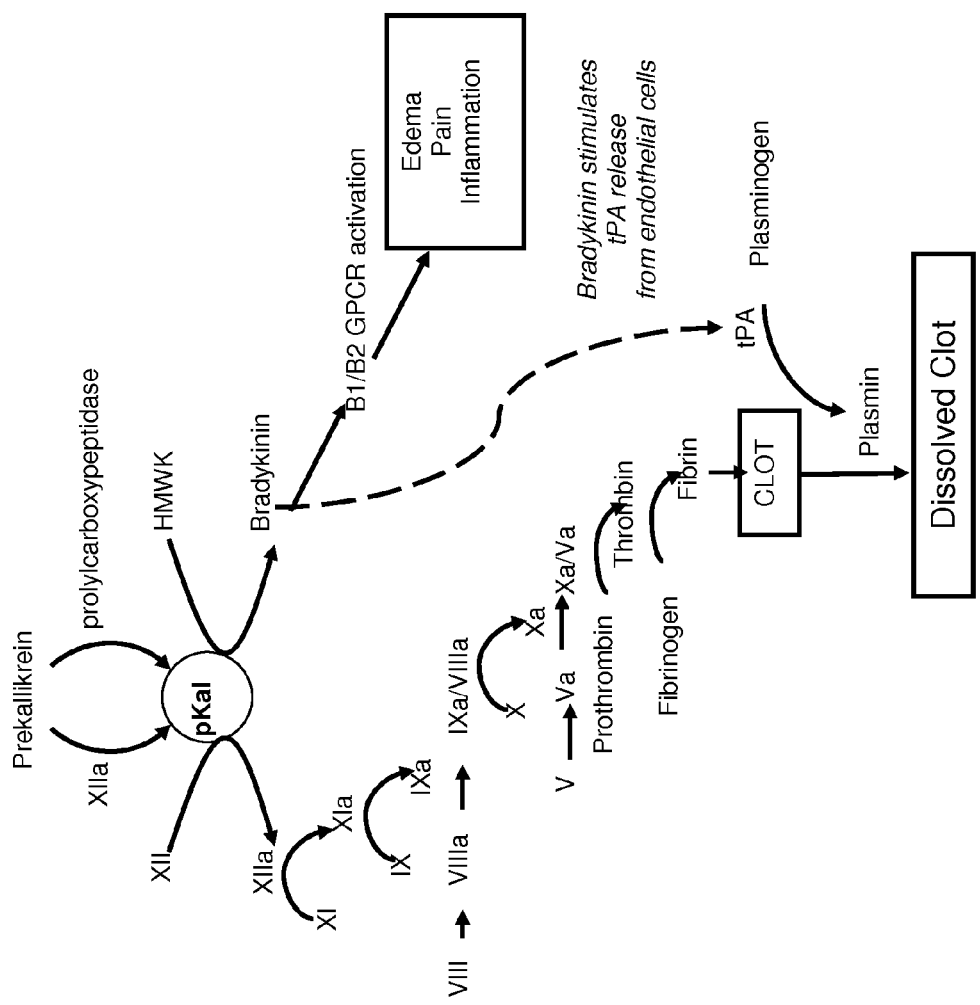
FIG. 1 is a schematic representation of the role of plasma kallikrein (pKal) in intrinsic coagulation pathway and inflammation.

For convenience, before further description of the present invention, certain terms employed in the specification, examples and appended claims are defined here. Other terms are defined as they appear in the specification.

The singular forms "a", "an", and "the" include plural references unless the context clearly dictates otherwise.

The term "agonist," as used herein, is meant to refer to an agent that mimics or up-regulates (e.g., potentiates or supplements) the bioactivity of a protein. An agonist can be a wild-type protein or derivative thereof having at least one bioactivity of the wild-type protein. An agonist can also be a compound which increases at least one bioactivity of a protein. An agonist can also be a compound which increases the interaction of a polypeptide with another molecule, e.g., a target peptide or nucleic acid.

"Antagonist" as used herein is meant to refer to an agent that downregulates (e.g., suppresses or inhibits) at least one bioactivity of a protein. An antagonist can be a compound which inhibits or decreases the interaction between a protein and another molecule, e.g., a target peptide or enzyme substrate. An antagonist can also be a compound which reduces the amount of expressed protein present.

The term "antibody" refers to a protein that includes at least one immunoglobulin variable domain (variable region) or immunoglobulin variable domain (variable region) sequence. For example, an antibody can include a heavy (H) chain variable region (abbreviated herein as VH or HV), and a light (L) chain variable region (abbreviated herein as VL or LV). In another example, an antibody includes two heavy (H) chain variable regions and two light (L) chain variable regions. The term "antibody" encompasses antigen-binding fragments of antibodies (e.g., single chain antibodies, Fab and sFab fragments, F(ab')$_2$, Fd fragments, Fv fragments, scFv, and domain antibodies (dAb) fragments (de Wildt et al., Eur J. Immunol. 1996; 26(3):629-39)) as well as complete antibodies. An antibody can have the structural features of IgA, IgG, IgE, IgD, IgM (as well as subtypes thereof). Antibodies may be from any source, but primate (human and non-human primate) and primatized are preferred.

The VH and VL regions can be further subdivided into regions of hypervariability, termed "complementarity determining regions" ("CDRs"), interspersed with regions that are more conserved, termed "framework regions" ("FRs"). The extent of the framework region and CDRs have been defined (see, Kabat, E. A., et al. (1991) Sequences of Proteins of Immunological Interest, Fifth Edition, U.S. Department of Health and Human Services, NIH Publication No. 91-3242, and Chothia, C. et al. (1987) J. Mol. Biol. 196:901-917). Kabat definitions are used herein. Each VH and VL is typically composed of three CDRs and four FRs, arranged from amino-terminus to carboxy-terminus in the following order: FR1, CDR1, FR2, CDR2, FR3, CDR3, FR4.

As used herein, an "immunoglobulin variable domain sequence" refers to an amino acid sequence which can form the structure of an immunoglobulin variable domain such that one or more CDR regions are positioned in a conformation suitable for an antigen binding site. For example, the sequence may include all or part of the amino acid sequence of a naturally-occurring variable domain. For example, the sequence may omit one, two or more N- or C-terminal amino acids, internal amino acids, may include one or more insertions or additional terminal amino acids, or may include other alterations. In one embodiment, a polypeptide that includes immunoglobulin variable domain sequence can associate with another immunoglobulin variable domain sequence to form an antigen binding site, e.g., a structure that preferentially interacts with plasma kallikrein.

The VH or VL chain of the antibody can further include all or part of a heavy or light chain constant region, to thereby form a heavy or light immunoglobulin chain, respectively. In one embodiment, the antibody is a tetramer of two heavy immunoglobulin chains and two light immunoglobulin chains, wherein the heavy and light immunoglobulin chains are inter-connected by, e.g., disulfide bonds. In IgGs, the heavy chain constant region includes three immunoglobulin domains, CH1, CH2 and CH3. The light chain constant region includes a CL domain. The variable region of the heavy and light chains contains a binding domain that interacts with an antigen. The constant regions of the antibodies typically mediate the binding of the antibody to host tissues or factors, including various cells of the immune system (e.g., effector cells) and the first component (C1q) of the classical complement system. The light chains of the immunoglobulin may be of types kappa or lambda. In one embodiment, the antibody is glycosylated. An antibody can be functional for antibody-dependent cytotoxicity and/or complement-mediated cytotoxicity.

One or more regions of an antibody can be human or effectively human. For example, one or more of the variable regions can be human or effectively human. For example, one or more of the CDRs can be human, e.g., HC CDR1, HC CDR2, HC CDR3, LC CDR1, LC CDR2, and/or LC CDR3. Each of the light chain (LC) and/or heavy chain (HC) CDRs can be human. HC CDR3 can be human. One or more of the framework regions can be human, e.g., FR1, FR2, FR3, and/or FR4 of the HC and/or LC. For example, the Fc region can be human. In one embodiment, all the framework regions are human, e.g., derived from a human somatic cell, e.g., a hematopoietic cell that produces immunoglobulins or a non-hematopoietic cell. In one embodiment, the human sequences are germline sequences, e.g., encoded by a germline nucleic acid. In one embodiment, the framework (FR) residues of a selected Fab can be converted to the amino-acid type of the corresponding residue in the most similar primate germline gene, especially the human germline gene. One or more of the constant regions can be human or effectively human. For example, at least 70, 75, 80, 85, 90, 92, 95, 98, or 100% of an immunoglobulin variable domain, the constant region, the constant domains (CH1, CH2, CH3, and/or CL1), or the entire antibody can be human or effectively human.

All or part of an antibody can be encoded by an immunoglobulin gene or a segment thereof. Exemplary human immunoglobulin genes include the kappa, lambda, alpha (IgA1 and IgA2), gamma (IgG1, IgG2, IgG3, IgG4), delta, epsilon and mu constant region genes, as well as the many immunoglobulin variable region genes. Full-length immunoglobulin "light chains" (about 25 KDa or about 214 amino acids) are encoded by a variable region gene at the NH2-terminus (about 110 amino acids) and a kappa or lambda constant region gene at the COOH-terminus. Full-length immunoglobulin "heavy chains" (about 50 KDa or about 446 amino acids), are similarly encoded by a variable region gene (about 116 amino acids) and one of the other aforementioned constant region genes, e.g., gamma (encoding about 330 amino acids). The length of human HC varies considerably because HC CDR3 varies from about 3 amino-acid residues to over 35 amino-acid residues.

The term "antigen-binding fragment" of a full length antibody refers to one or more fragments of a full-length antibody that retain the ability to specifically bind to a target of interest. Examples of binding fragments encompassed within the term "antigen-binding fragment" of a full length antibody and that retain functionality include (i) a Fab fragment, a monovalent fragment consisting of the VL, VH, CL and CH1 domains; (ii) a F(ab')$_2$ fragment, a bivalent fragment including two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR). Furthermore, although the two domains of the Fv fragment, VL and VH, are coded for by separate genes, they can be joined, using recombinant methods, by a synthetic linker that enables them to be made as a single protein chain in which the VL and VH regions pair to form monovalent molecules known as single chain Fv (scFv). See e.g., U.S. Pat. Nos. 5,260,203, 4,946,778, and 4,881,175; Bird et al. (1988) Science 242:423-426; and Huston et al. (1988) Proc. Natl. Acad. Sci. USA 85:5879-5883.

Antibody fragments can be obtained using any appropriate technique including conventional techniques known to those with skill in the art. The term "monospecific antibody" refers to an antibody that displays a single binding specificity and affinity for a particular target, e.g., epitope. This term includes a "monoclonal antibody" or "monoclonal antibody composition," which as used herein refers to a preparation of antibodies or fragments thereof of single molecular composition, irrespective of how the antibody was generated.

Antibodies are "germlined" by reverting one or more non-germline amino acids in framework regions to corresponding germline amino acids of the antibody, so long as binding properties are substantially retained.

The inhibition constant (Ki) provides a measure of inhibitor potency; it is the concentration of inhibitor required to reduce enzyme activity by half and is not dependent on enzyme or substrate concentrations. The apparent Ki ($K_{i,app}$) is obtained at different substrate concentrations by measuring the inhibitory effect of different concentrations of inhibitor (e.g., inhibitory binding protein) on the extent of the reaction (e.g., enzyme activity); fitting the change in pseudo-first order rate constant as a function of inhibitor concentration to the Morrison equation (Equation 1) yields an estimate of the apparent Ki value. The Ki is obtained from the y-intercept extracted from a linear regression analysis of a plot of Ki,app versus substrate concentration.

$$v = v_o - v_o\left(\frac{(K_{i,app} + I + E) - \sqrt{(K_{i,app} + I + E)^2 - 4 \cdot I \cdot E}}{2 \cdot E}\right) \quad \text{Equation 1}$$

Where v=measured velocity; $v_0$=velocity in the absence of inhibitor; $K_{i,app}$=apparent inhibition constant; I=total inhibitor concentration; and E=total enzyme concentration.

As used herein, "binding affinity" refers to the apparent association constant or $K_A$. The $K_A$ is the reciprocal of the dissociation constant ($K_D$). A binding protein may, for example, have a binding affinity of at least $10^5$, $10^6$, $10^7$, $10^8$, $10^9$, $10^{10}$ and $10^{11}$ $M^{-1}$ for a particular target molecule, e.g., plasma kallikrein. Higher affinity binding of a binding protein to a first target relative to a second target can be indicated by a higher $K_A$ (or a smaller numerical value $K_D$) for binding the first target than the $K_A$ (or numerical value $K_D$) for binding the second target. In such cases, the binding protein has specificity for the first target (e.g., a protein in a first conformation or mimic thereof) relative to the second target (e.g., the same protein in a second conformation or mimic thereof; or a second protein). Differences in binding affinity (e.g., for specificity or other comparisons) can be at least 1.5, 2, 3, 4, 5, 10, 15, 20, 37.5, 50, 70, 80, 91, 100, 500, 1000, 10,000 or $10^5$ fold.

Binding affinity can be determined by a variety of methods including equilibrium dialysis, equilibrium binding, gel filtration, ELISA, surface plasmon resonance, or spectroscopy (e.g., using a fluorescence assay). Exemplary conditions for evaluating binding affinity are in HBS-P buffer (10 mM HEPES pH7.4, 150 mM NaCl, 0.005% (v/v) Surfactant P20). These techniques can be used to measure the concentration of bound and free binding protein as a function of binding protein (or target) concentration. The concentration of bound binding protein ([Bound]) is related to the concentration of free binding protein ([Free]) and the concentration of binding sites for the binding protein on the target where (N) is the number of binding sites per target molecule by the following equation:

[Bound]=$N \cdot$[Free]/((1/$K_A$)+[Free]).

It is not always necessary to make an exact determination of $K_A$, though, since sometimes it is sufficient to obtain a quantitative measurement of affinity, e.g., determined using a method such as ELISA or FACS analysis, is proportional to $K_A$, and thus can be used for comparisons, such as determining whether a higher affinity is, e.g., 2-fold higher, to obtain a qualitative measurement of affinity, or to obtain an inference of affinity, e.g., by activity in a functional assay, e.g., an in vitro or in vivo assay.

The term "binding protein" refers to a protein that can interact with a target molecule. This term is used interchangeably with "ligand." A "plasma kallikrein binding protein" refers to a protein that can interact with (e.g., bind) plasma kallikrein, and includes, in particular, proteins that preferentially or specifically interact with and/or inhibit plasma kallikrein. A protein inhibits plasma kallikrein if it causes a decrease in the activity of plasma kallikrein as compared to the activity of plasma kallikrein in the absence of the protein and under the same conditions. In some embodiments, the plasma kallikrein binding protein is an antibody.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

It is possible for one or more framework and/or CDR amino acid residues of a binding protein to include one or more mutations (e.g., substitutions (e.g., conservative substitutions or substitutions of non-essential amino acids), insertions, or deletions) relative to a binding protein described herein. A plasma kallikrein binding protein may have mutations (e.g., substitutions (e.g., conservative substitutions or substitutions of non-essential amino acids), insertions, or deletions) (e.g., at least one, two, three, or four, and/or less than 15, 12, 10, 9, 8, 7, 6, 5, 4, 3, or 2 mutations) relative to a binding protein described herein, e.g., mutations which do not have a substantial effect on protein function. The mutations can be present in framework regions, CDRs, and/or constant regions. In some embodiments, the mutations are present in a framework region. In some embodiments, the mutations are present in a CDR. In some embodiments, the mutations are present in a constant region. Whether or not a particular substitution will be tolerated, i.e., will not adversely affect biological properties, such as binding activity, can be predicted, e.g., by evaluating whether the mutation is conservative or by the method of Bowie, et al. (1990) Science 247:1306-1310.

Motif sequences for biopolymers can include positions which can be varied amino acids. For example, the symbol "X" in such a context generally refers to any amino acid (e.g., any of the twenty natural amino acids) unless otherwise specified, e.g., to refer to any non-cysteine amino acid. Other allowed amino acids can also be indicated for example, using parentheses and slashes. For example, "(A/W/F/N/Q)" means that alanine, tryptophan, phenylalanine, asparagine, and glutamine are allowed at that particular position.

An "effectively human" immunoglobulin variable region is an immunoglobulin variable region that includes a sufficient number of human framework amino acid positions such that the immunoglobulin variable region does not elicit an immunogenic response in a normal human. An "effectively human" antibody is an antibody that includes a sufficient number of human amino acid positions such that the antibody does not elicit an immunogenic response in a normal human An "epitope" refers to the site on a target compound that is bound by a binding protein (e.g., an antibody such as a Fab or full length antibody). In the case where the target compound is a protein, the site can be entirely composed of amino acid components, entirely composed of chemical modifications of amino acids of the protein (e.g., glycosyl moieties), or composed of combinations thereof. Overlapping epitopes include at least one common amino acid residue, glycosyl group, phosphate group, sulfate group, or other molecular feature.

A first binding protein (e.g., antibody) "binds to the same epitope" as a second binding protein (e.g., antibody) if the first binding protein binds to the same site on a target compound that the second binding protein binds, or binds to a site that overlaps (e.g., 50%, 60%, 70%, 80%, 90%, or 100% overlap, e.g., in terms of amino acid sequence or other molecular feature (e.g., glycosyl group, phosphate group, or sulfate group)) with the site that the second binding protein binds.

A first binding protein (e.g., antibody) "competes for binding" with a second binding protein (e.g., antibody) if the binding of the first binding protein to its epitope decreases (e.g., by 10%, 20%, 30%, 40%, 50%, 60%, 70%, 80%, 90%, 100%, or more) the amount of the second binding protein that binds to its epitope. The competition can be direct (e.g., the first binding protein binds to an epitope that is the same as, or overlaps with, the epitope bound by the second binding protein), or indirect (e.g., the binding of the first binding protein to its epitope causes a steric change in the target compound that decreases the ability of the second binding protein to bind to its epitope).

Calculations of "homology" or "sequence identity" between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frameshift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences.

In a preferred embodiment, the length of a reference sequence aligned for comparison purposes is at least 30%, preferably at least 40%, more preferably at least 50%, even more preferably at least 60%, and even more preferably at least 70%, 80%, 90%, 92%, 95%, 97%, 98%, or 100% of the length of the reference sequence. For example, the reference sequence may be the length of the immunoglobulin variable domain sequence.

A "humanized" immunoglobulin variable region is an immunoglobulin variable region that is modified to include a sufficient number of human framework amino acid positions such that the immunoglobulin variable region does not elicit an immunogenic response in a normal human Descriptions of "humanized" immunoglobulins include, for example, U.S. Pat. No. 6,407,213 and U.S. Pat. No. 5,693,762.

As used herein, the term "hybridizes under low stringency, medium stringency, high stringency, or very high stringency conditions" describes conditions for hybridization and washing. Guidance for performing hybridization reactions can be found in Current Protocols in Molecular Biology, John Wiley & Sons, N.Y. (1989), 6.3.1-6.3.6. Aqueous and nonaqueous methods are described in that reference and either can be used. Specific hybridization conditions referred to herein are as follows: (1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); (2) medium stringency hybridization conditions in 6×SSC at about 45° C., followed by one or more washes in 0.2×SSC, 0.1% SDS at 60° C.; (3) high stringency hybridization conditions in 6×SSC at about 45° C., followed by one or more washes in 0.2×SSC, 0.1% SDS at 65° C.; and (4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions and the ones that should be used unless otherwise specified. The disclosure includes nucleic acids that hybridize with low, medium, high, or very high stringency to a nucleic acid described herein or to a complement thereof, e.g., nucleic acids encoding a binding protein described herein. The nucleic acids can be the same length or within 30, 20, or 10% of the length of the reference nucleic acid. The nucleic acid can correspond to a region encoding an immunoglobulin variable domain sequence described herein.

An "isolated composition" refers to a composition that is removed from at least 90% of at least one component of a natural sample from which the isolated composition can be obtained. Compositions produced artificially or naturally can be "compositions of at least" a certain degree of purity if the species or population of species of interest is at least 5, 10, 25, 50, 75, 80, 90, 92, 95, 98, or 99% pure on a weight-weight basis.

An "isolated" protein refers to a protein that is removed from at least 90% of at least one component of a natural sample from which the isolated protein can be obtained. Proteins can be "of at least" a certain degree of purity if the species or population of species of interest is at least 5, 10, 25, 50, 75, 80, 90, 92, 95, 98, or 99% pure on a weight-weight basis.

The term "modulator" refers to a polypeptide, nucleic acid, macromolecule, complex, molecule, small molecule, compound, species or the like (naturally-occurring or non-naturally-occurring), or an extract made from biological materials such as bacteria, plants, fungi, or animal cells or tissues, that may be capable of causing modulation. Modulators may be evaluated for potential activity as inhibitors or activators (directly or indirectly) of a functional property, biological activity or process, or combination of them, (e.g., agonist, partial antagonist, partial agonist, inverse agonist, antagonist, antimicrobial agents, inhibitors of microbial infection or proliferation, and the like) by inclusion in assays. In such assays, many modulators may be screened at one time. The activity of a modulator may be known, unknown or partially known.

A "non-essential" amino acid residue is a residue that can be altered from the wild-type sequence of the binding agent, e.g., the antibody, without abolishing or more preferably, without substantially altering a biological activity, whereas changing an "essential" amino acid residue results in a substantial loss of activity.

A "patient," "subject" or "host" (these terms are used interchangeably) to be treated by the subject method may mean either a human or non-human animal.

The terms "prekallikrein" and "preplasma kallikrein" are used interchangeably herein and refer to the zymogen form of active plasma kallikrein, which is also known as prekallikrein.

The term "preventing" or to "prevent" a disease in a subject refers to subjecting the subject to a pharmaceutical treatment, e.g., the administration of a drug, such that at least one symptom of the disease is prevented, that is, administered prior to clinical manifestation of the unwanted condition (e.g., disease or other unwanted state of the host animal) so that it protects the host against developing the unwanted condition. "Preventing" a disease may also be referred to as "prophylaxis" or "prophylactic treatment."

As used herein, the term "substantially identical" (or "substantially homologous") is used herein to refer to a first amino acid or nucleic acid sequence that contains a sufficient number of identical or equivalent (e.g., with a similar side chain, e.g., conserved amino acid substitutions) amino acid residues or nucleotides to a second amino acid or nucleic acid sequence such that the first and second amino acid or nucleic acid sequences have (or encode proteins having) similar activities, e.g., a binding activity, a binding preference, or a biological activity. In the case of antibodies, the second antibody has the same specificity and has at least 50%, at least 25%, or at least 10% of the affinity relative to the same antigen.

Sequences similar or homologous (e.g., at least about 85% sequence identity) to the sequences disclosed herein are also part of this application. In some embodiments, the sequence identity can be about 85%, 90%, 91%, 92%, 93%, 94%, 95%, 96%, 97%, 98%, 99% or higher. In some embodiments, a plasma kallikrein binding protein can have about 85%, 90%, 91%, 92%, 93%, 94%, 95%, 96%, 97%, 98%, 99% or higher sequence identity to a binding protein described herein. In some embodiments, a plasma kallikrein binding protein can have about 85%, 90%, 91%, 92%, 93%, 94%, 95%, 96%, 97%, 98%, 99% or higher sequence identity in the HC and/or LC framework regions (e.g., HC and/or LC FR 1, 2, 3, and/or 4) to a binding protein described herein. In some embodiments, a plasma kallikrein binding protein can have about 85%, 90%, 91%, 92%, 93%, 94%, 95%, 96%, 97%, 98%, 99% or higher sequence identity in the HC and/or LC CDRs (e.g., HC and/or LC CDR1, 2, and/or 3) to a binding protein described herein. In some embodiments, a plasma kallikrein binding protein can have about 85%, 90%, 91%, 92%, 93%, 94%, 95%, 96%, 97%, 98%, 99% or higher sequence identity in the constant region (e.g., CH1, CH2, CH3, and/or CL1) to a binding protein described herein.

In addition, substantial identity exists when the nucleic acid segments hybridize under selective hybridization conditions (e.g., highly stringent hybridization conditions), to the complement of the strand. The nucleic acids may be present in whole cells, in a cell lysate, or in a partially purified or substantially pure form.

Statistical significance can be determined by any art known method. Exemplary statistical tests include: the Students T-test, Mann Whitney U non-parametric test, and Wilcoxon non-parametric statistical test. Some statistically significant relationships have a P value of less than 0.05 or 0.02. Particular binding proteins may show a difference, e.g., in specificity or binding that are statistically significant (e.g., P value <0.05 or 0.02). The terms "induce", "inhibit", "potentiate", "elevate", "increase", "decrease" or the like, e.g., which denote distinguishable qualitative or quantitative differences between two states, may refer to a difference, e.g., a statistically significant difference, between the two states.

A "therapeutically effective dosage" preferably modulates a measurable parameter, e.g., plasma kallikrein activity, by a statistically significant degree or at least about 20%, more preferably by at least about 40%, even more preferably by at least about 60%, and still more preferably by at least about 80% relative to untreated subjects. The ability of a compound to modulate a measurable parameter, e.g., a disease-associated parameter, can be evaluated in an animal model system predictive of efficacy in human disorders and conditions, e.g., rheumatoid arthritis or oral mucositis. Alternatively, this property of a composition can be evaluated by examining the ability of the compound to modulate a parameter in vitro.

"Treating" a disease (or condition) in a subject or "treating" a subject having a disease refers to subjecting the subject to a pharmaceutical treatment, e.g., the administration of a drug, such that at least one symptom of the disease is cured, alleviated or decreased.

The term "preventing" a disease in a subject refers to subjecting the subject to a pharmaceutical treatment, e.g., the administration of a drug, such that at least one symptom of the disease is prevented, that is, administered prior to clinical manifestation of the unwanted condition (e.g., disease or other unwanted state of the host animal) so that it protects the host against developing the unwanted condition. "Preventing" a disease may also be referred to as "prophylaxis" or "prophylactic treatment."

A "prophylactically effective amount" refers to an amount effective, at dosages and for periods of time necessary, to achieve the desired prophylactic result. Typically, because a prophylactic dose is used in subjects prior to or at an earlier stage of disease, the prophylactically effective amount will be less than the therapeutically effective amount.

As used herein the term "DX-2922" as used inchangeably with the term "X101-A01". Other variants of this antibody are described below.

| Antibody Identification | Description |
| --- | --- |
| X63-G06 | Non-germlined Fab discovered using ROLIC, same HC but different LC as M160-G12 |
| X81-B01 | Germlined IgG produced in HEK 293T cells |
| X101-A01 | Germlined IgG produced in CHO cells, same HC and LC sequence as X81-B01 |
| DX-2922 | Alternate nomenclature for X101-A01 |

As used herein the term "DX-2930" as used inchangeably with the term "X124-G01". Other variants of this antibody are described below.

| Antibody Identification | Description |
| --- | --- |
| M162-A04 | Non-germlined Fab discovered using phage display |
| M199-A08 | Heavy chain CDR3 varied Fab derived by affinity maturation of M162-A04 |
| X115-F02 | Germlined Fab produced in 293T cells, same variable heavy chain as X124-G01 |
| X124-G01 or DX-2930 | Germlined IgG produced in CHO cells, same variable heavy chain as X115-F02, same variable LC as X115-F02 except C-terminal Lys is removed |

As used herein the term "unstructured recombinant polymer" (URP) refers to an amino acid sequence that lacks a secondary structure and shares commonality with denatured peptide sequences, e.g., exhibiting a typical behavior like denatured peptide sequences, under physiological conditions. URP sequences lack a defined tertiary structure and they have limited or no secondary structure as detected by, e.g., Chou-Fasman algorithm.

Plasma Kallikrein Binding Proteins

Plasma kallikrein binding proteins can be full-length (e.g., an IgG (e.g., an IgG1, IgG2, IgG3, IgG4), IgM, IgA (e.g., IgA1, IgA2), IgD, and IgE) or can include only an antigen-binding fragment (e.g., a Fab, F(ab')2 or scFv fragment. The binding protein can include two heavy chain immunoglobulins and two light chain immunoglobulins, or can be a single chain antibody. Plasma kallikrein binding proteins can be recombinant proteins such as humanized, CDR grafted, chimeric, deimmunized, or in vitro generated antibodies, and may optionally include constant regions derived from human germline immunoglobulin sequences. In one embodiment, the plasma kallikrein binding protein is a monoclonal antibody.

In one aspect, the disclosure features a protein (e.g., an isolated protein) that binds to plasma kallikrein (e.g., human plasma kallikrein and/or murine kallikrein) and includes at least one immunoglobulin variable region. For example, the protein includes a heavy chain (HC) immunoglobulin variable domain sequence and/or a light chain (LC) immunoglobulin variable domain sequence. In one embodiment, the protein binds to and inhibits plasma kallikrein, e.g., human plasma kallikrein and/or murine kallikrein.

The protein can include one or more of the following characteristics: (a) a human CDR or human framework region; (b) the HC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a HC variable domain described herein; (c) the LC immunoglobulin variable domain sequence comprises one or more (e.g., 1, 2, or 3) CDRs that are at least 85, 88, 89, 90, 91, 92, 93, 94, 95, 96, 97, 98, 99, or 100% identical to a CDR of a LC variable domain described herein; (d) the LC immunoglobulin variable domain sequence is at least 85, 88, 89, 90, 91, 92, 93, 94, 95, 96, 97, 98, 99, or 100% identical to a LC variable domain described herein (e.g., overall or in framework regions or CDRs); (e) the HC immunoglobulin variable domain sequence is at least 85, 88, 89, 90, 91, 92, 93, 94, 95, 96, 97, 98, 99, or 100% identical to a HC variable domain described herein (e.g., overall or in framework regions or CDRs); (f) the protein binds an epitope bound by a protein described herein, or competes for binding with a protein described herein; (g) a primate CDR or primate framework region; (h) the HC immunoglobulin variable domain sequence comprises a CDR1 that differs by at least one amino acid but by no more than 2 or 3 amino acids from the CDR1 of a HC variable domain described herein; (i) the HC immunoglobulin variable domain sequence comprises a CDR2 that differs by at least one amino acid but by no more than 2, 3, 4, 5, 6, 7, or 8 amino acids from the CDR2 of a HC variable domain described herein; (j) the HC immunoglobulin variable domain sequence comprises a CDR3 that differs by at least one amino acid but by no more than 2, 3, 4, 5, or 6 amino acids from the CDR3 of a HC variable domain described herein; (k) the LC immunoglobulin variable domain sequence comprises a CDR1 that differs by at least one amino acid but by no more than 2, 3, 4, or 5 amino acids from the CDR1 of a LC variable domain described herein; (l) the LC immunoglobulin variable domain sequence comprises a CDR2 that differs by at least one amino acid but by no more than 2, 3, or 4 amino acids from the CDR2 of a LC variable domain described herein; (m) the LC immunoglobulin variable domain sequence comprises a CDR3 that differs by at least one amino acid but by no more than 2, 3, 4, or 5 amino acids from the CDR3 of a LC variable domain described herein; (n) the LC immunoglobulin variable domain sequence differs by at least one amino acid but by no more than 2, 3, 4, 5, 6, 7, 8, 9, or 10 amino acids from a LC variable domain described herein (e.g., overall or in framework regions or CDRs); and (o) the HC immunoglobulin variable domain sequence differs by at least one amino acid but by no more than 2, 3, 4, 5, 6, 7, 8, 9, or 10 amino acids from a HC variable domain described herein (e.g., overall or in framework regions or CDRs).

The plasma kallikrein binding protein may be an isolated protein (e.g., at least 70, 80, 90, 95, or 99% free of other proteins). In some embodiments, the plasma kallikrein binding protein, or composition thereof, is isolated from antibody cleavage fragments (e.g., cleaved DX-2922) that are inactive or partially active (e.g., bind plasma kallikrein with a Ki, app of 5000 nM or greater) compared to the plasma kallikrein binding protein. For example, the plasma kallikrein binding protein is at least 70% free of such antibody cleavage fragments; in other embodiments the binding protein is at least 80%, at least 90%, at least 95%, at least 99% or even 100% free from antibody cleavage fragments that are inactive or partially active.

The plasma kallikrein binding protein may additionally inhibit plasma kallikrein, e.g., human plasma kallikrein.

In some embodiments, the plasma kallikrein binding protein does not bind prekallikrein (e.g., human prekallikrein and/or murine prekallikrein), but binds to the active form of plasma kallikrein (e.g., human plasma kallikrein and/or murine kallikrein).

In certain embodiments, the protein binds at or near the active site of the catalytic domain of plasma kallikrein, or a fragment thereof, or binds an epitope that overlaps with the active site of plasma kallikrein.

In some aspects, the protein binds the same epitope or competes for binding with a protein described herein.

In some embodiments, the protein competes with or binds the same epitope as M162-A04, M160-G12, M142-H08, X63-G06, X101-A01, X81-B01, X67-D03, X67-G04, X115-B07, X115-D05, X115-E09, X115-H06, X115-A03, X115-D01, X115-F02, X115-G04, M29-D09, M145-D11, M06-D09 and M35-G04.

In some embodiments, the protein binds to (e.g., positions on plasma kallikrein corresponding to) CLIPS peptide C1, C2, C3, C4, C5, C6, or C7, or more than one of these peptides, e.g., the protein binds to C5 and C6. CLIPS peptides C1-C7 are peptides in plasma kallikrein identified by CLIPS epitope mapping (see FIGS. 9 and 10A-10C). C1 corresponds to positions 55-67 of the catalytic domain, C2 to positions 81-94, C3 to positions 101-108, C4 to positions 137-151, C5 to positions 162-178, C6 to positions 186-197, and C7 to positions 214-217 of plasma kallikrein.

Figure 9:
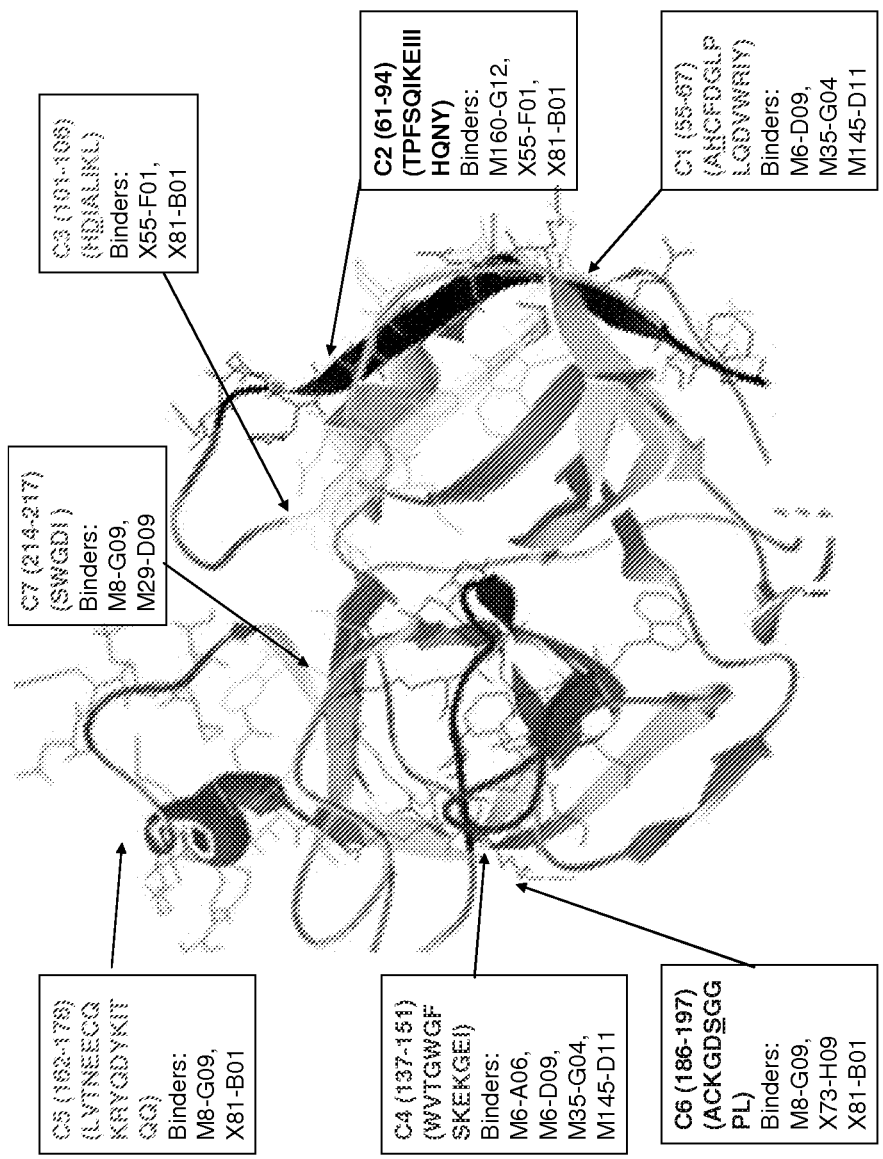
FIG. 9 depicts the results of CLIPS epitope mapping for antibodies listed in Table 12 (SEQ ID NOS 2566-2572, respectively, in order of appearance).
Figure 11A:
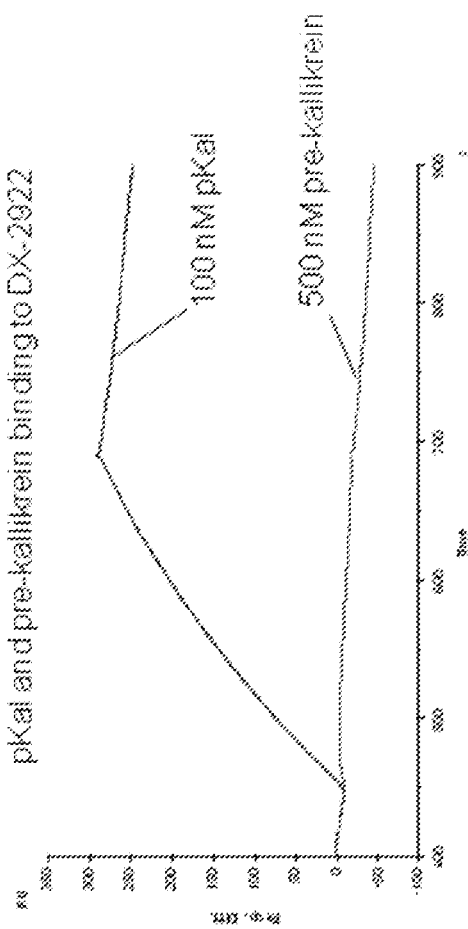
FIGS. 11A and 11B depict a Biacore competition analysis with epi-ka12, as described herein in Example 12, for (i) DX-2922, and (ii) M6-D09 antibodies.
Figure 11B:
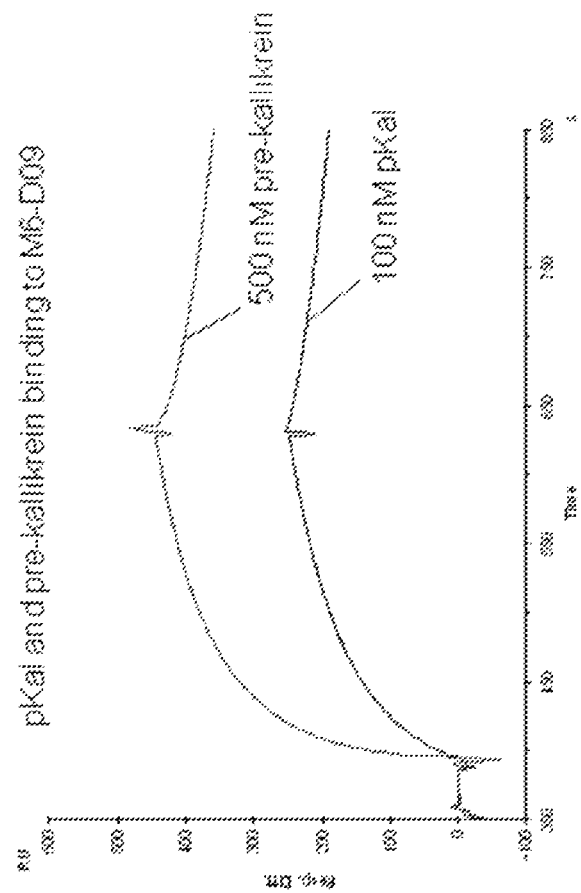
Figure 12:
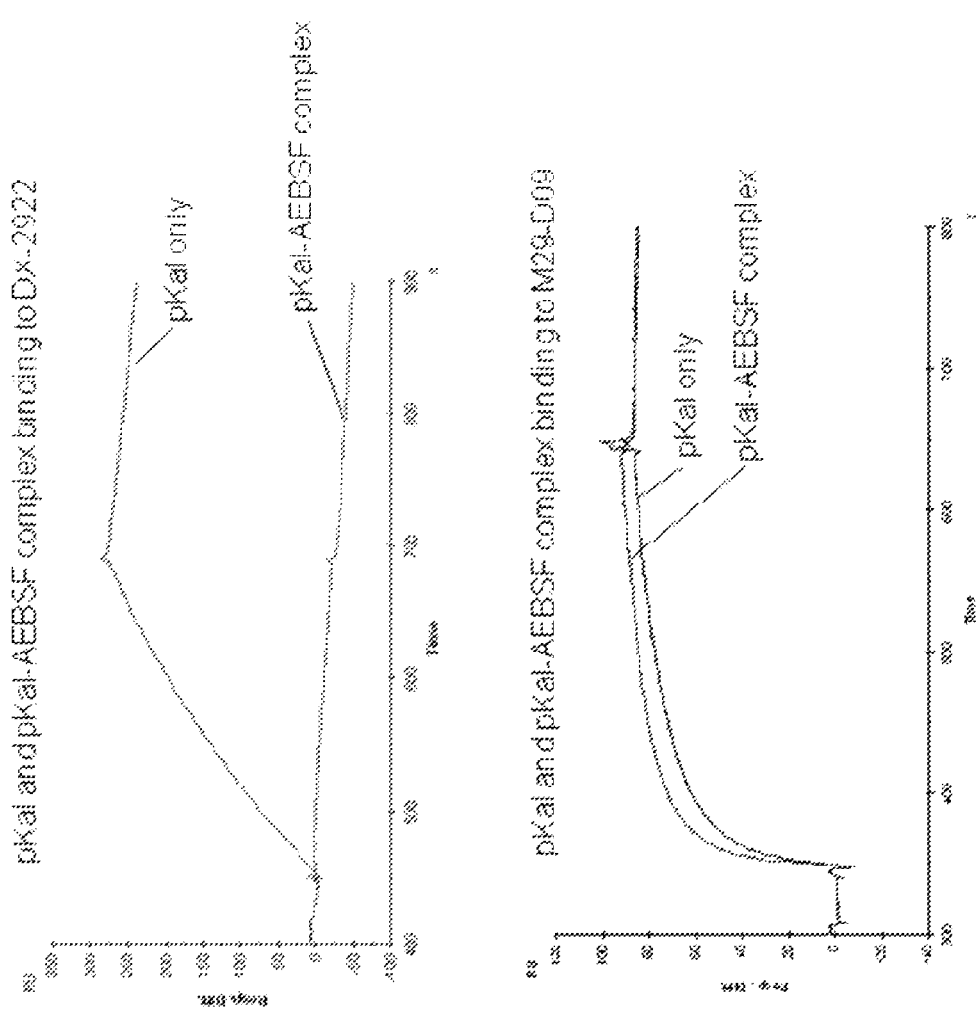
FIG. 12 depicts a Biacore competition analysis with AEBSF, as described herein in Example 12, for (i) DX-2911, and (ii) M6-D09 antibodies.
Figure 13:
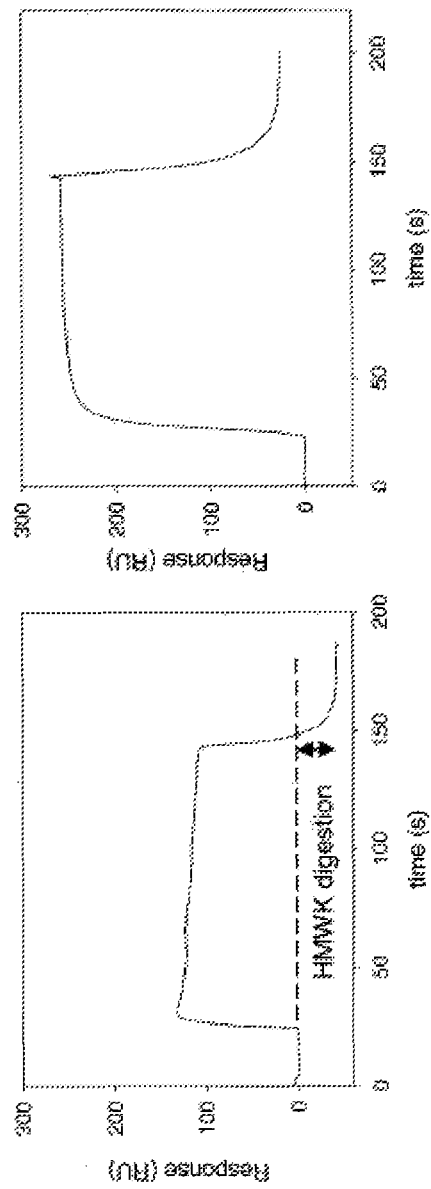
FIG. 13 depicts a Biocore analysis showing that DX-2922 binds to plasma kallikrein that bound to high molecular weight kininogen (HMWK).

In some embodiments, the protein binds to an epitope shown in FIG. 9.

In some embodiments, the protein binds to one or more amino acids that form the catalytic triad of plasma kallikrein: His434, Asp483, and/or Ser578 (numbering based on the human sequence).

In some embodiments, the protein binds one or more amino acids of: Arg551, Gln553, Tyr555, Thr558, and/or Arg560 (numbering based on the human sequence). In some embodiments, the plasma kallikrein binding protein binds one or more amino acids of: S478, N481, S525, and K526 (numbering based on the human kallikrein sequence).

In some embodiments, the protein binds to one or more amino acids of Ser479, Tyr563, and/or Asp585 (numbering based on the human sequence).

The active site cleft of plasma kallikrein contains three amino acids that form the catalytic triad (His434, Asp483, and Ser578) and result in enzymatic hydrolysis of bound substrate (catalytic triad residues are underlined in FIG. 10). The peptides selected for the CLIPS epitope mapping analysis were determined to be surface accessible and either form or surround the vicinity of the active site. Peptide C1 contains the active site histidine 434. Peptide C3 contains the active site aspartate 483. Peptide C6 contains the active site serine 578. It is possible for an antibody to bind multiple surface exposed amino acids that are discontinuous in amino acid sequence. For example, by CLIPs analysis, X81-B01 appears to bind the C2, C3, C5 and the C6 peptides.

In some embodiments, the protein binds to an epitope that includes one or more amino acids from CLIPS peptide C1, peptide C2, peptide C3, peptide C4, peptide C5, peptide C6, or peptide C7.

In some embodiments, the protein binds to an epitope that includes amino acids from at least 2 different CLIPS peptides, e.g., from at least two of peptide C1, peptide C2, peptide C3, peptide C4, peptide C5, peptide C6, or peptide C7.

The protein can bind to plasma kallikrein, e.g., human plasma kallikrein, with a binding affinity of at least $10^5$, $10^6$, $10^7$, $10^8$, $10^9$, $10^{10}$ and $10^{11}$ M$^{-1}$. In one embodiment, the protein binds to human plasma kallikrein with a $K_{off}$ slower than $1\times10^{-3}$, $5\times10^{-4}$ s$^{-1}$, or $1\times10^{-4}$ s$^{-1}$. In one embodiment, the protein binds to human plasma kallikrein with a $K_{on}$ faster than $1\times10^2$, $1\times10^3$, or $5\times10^3$ M$^{-1}$s$^{-1}$. In one embodiment, the protein binds to plasma kallikrein, but does not bind to tissue kallikrein and/or plasma prekallikrein (e.g., the protein binds to tissue kallikrein and/or plasma prekallikrein less effectively (e.g., 5-, 10-, 50-, 100-, or 1000-fold less or not at all, e.g., as compared to a negative control) than it binds to plasma kallikrein.

In one embodiment, the protein inhibits human plasma kallikrein activity, e.g., with a Ki of less than $10^{-5}$, $10^{-6}$, $10^{-7}$, $10^{-8}$, $10^{-9}$, and $10^{-10}$ M. The protein can have, for example, an IC$_{50}$ of less than 100 nM, 10 nM, 1, 0.5, or 0.2 nM. For example, the protein may modulate plasma kallikrein activity, as well as the production of Factor XIIa (e.g., from Factor XII) and/or bradykinin (e.g., from high-molecular-weight kininogen (HMWK)). The protein may inhibit plasma kallikrein activity, and/or the production of Factor XIIa (e.g., from Factor XII) and/or bradykinin (e.g., from high-molecular-weight kininogen (HMWK)). The affinity of the protein for human plasma kallikrein can be characterized by a $K_D$ of less than 100 nm, less than 10 nM, less than 5 nM, less than 1 nM, less than 0.5 nM. In one embodiment, the protein inhibits plasma kallikrein, but does not inhibit tissue kallikrein (e.g., the protein inhibits tissue kallikrein less effectively (e.g., 5-, 10-, 50-, 100-, or 1000-fold less or not at all, e.g., as compared to a negative control) than it inhibits plasma kallikrein.

In some embodiments, the protein has an apparent inhibition constant ($K_{i,app}$) of less than 1000, 500, 100, 5, 1, 0.5 or 0.2 nM.

Plasma kallikrein binding proteins may be antibodies. Plasma kallikrein binding antibodies may have their HC and LC variable domain sequences included in a single polypeptide (e.g., scFv), or on different polypeptides (e.g., IgG or Fab).

In a preferred embodiment, the protein is an antibody (e.g., a human antibody) having the light and heavy chains of antibodies selected from the group consisting of M162-A04, M199-A08, M160-G12, M142-H08 X63-G06, X101-A01, X81-B01, X67-D03, X67-G04, DX-2922, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having the heavy chain of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having the light chain of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having light and heavy antibody variable regions of an antibody selected from the group consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having a heavy chain antibody variable region of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having a light chain antibody variable region of an antibody selected from the group consisting of: M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs selected from the corresponding CDRs of the group of heavy chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) light chain CDRs selected from the corresponding CDRs of the group of light chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In a preferred embodiment, the protein is an antibody (e.g., a human antibody) having one or more (e.g., 1, 2, or 3) heavy chain CDRs and one or more (e.g., 1, 2, or 3) light chain CDRs selected from the corresponding CDRs of the group of light chains consisting of M162-A04, M199-A08, M160-G12, M142-H08, X63-G06, X101-A01, X81-B01, X67-D03, X67-G04, X115-B07, X115-D05, X115-E09, X115-H06, X115-A03, X115-D01, X115-F02, X124-G01, X115-G04, M29-D09, M145-D11, M06-D09 and M35-G04.

In one embodiment, the HC and LC variable domain sequences are components of the same polypeptide chain. In another, the HC and LC variable domain sequences are components of different polypeptide chains. For example, the protein is an IgG, e.g., IgG1, IgG2, IgG3, or IgG4. The protein can be a soluble Fab. In other implementations the protein includes a Fab2', scFv, minibody, scFv::Fc fusion, Fab::HSA fusion, HSA::Fab fusion, Fab::HSA::Fab fusion, or other molecule that comprises the antigen combining site of one of the binding proteins herein. The VH and VL regions of these Fabs can be provided as IgG, Fab, Fab2, Fab2', scFv, PEGylated Fab, PEGylated scFv, PEGylated Fab2, VH::CH1::HSA+LC, HSA::VH::CH1+LC, LC::HSA+VH::CH1, HSA::LC+VH::CH1, or other appropriate construction.

In one embodiment, the protein is a human or humanized antibody or is non-immunogenic in a human For example, the protein includes one or more human antibody framework regions, e.g., all human framework regions, or framework regions at least 85, 88, 89, 90, 91, 92, 93, 94, 95, 96, 97, 98, 99% identical to human framework regions. In one embodiment, the protein includes a human Fc domain, or an Fc domain that is at least 95, 96, 97, 98, or 99% identical to a human Fc domain.

In one embodiment, the protein is a primate or primatized antibody or is non-immunogenic in a human. For example, the protein includes one or more primate antibody framework regions, e.g., all primate framework regions, or framework regions at least 85, 88, 89, 90, 91, 92, 93, 94, 95, 96, 97, 98, 99% identical to primate framework regions. In one embodiment, the protein includes a primate Fc domain, or an Fc domain that is at least 95, 96, 97, 98, or 99% identical to a primate Fc domain. "Primate" includes humans (*Homo sapiens*), chimpanzees (*Pan troglodytes* and *Pan paniscus* (bonobos)), gorillas (*Gorilla gorilla*), gibons, monkeys, lemurs, aye-ayes (*Daubentonia madagascariensis*), and tarsiers.

plasma kallikrein) and include at least one immunoglobin variable region in methods for treating (or preventing) a plasma kallikrein associated disorder or condition. For example, the plasma kallikrein binding protein includes a heavy chain (HC) immunoglobulin variable domain sequence and a light chain (LC) immunoglobulin variable domain sequence. A number of exemplary plasma kallikrein binding proteins are described herein.

The plasma kallikrein binding protein may be an isolated protein (e.g., at least 70, 80, 90, 95, or 99% free of other proteins).

The plasma kallikrein binding protein may additionally inhibit plasma kallikrein, e.g., human plasma kallikrein and/or murine plasma kallikrein. In some embodiments, it may be preferred to have an plasma kallikrein binding protein bind to both human and murine plasma kallikrein, as these antibodies can be tested for efficacy in a mouse model.

Plasma Kallikrein

Exemplary plasma kallikrein sequences against which plasma kallikrein binding proteins may be developed can include human, mouse, or rat plasma kallikrein amino acid sequences, a sequence that is 80%, 85%, 90%, 95%, 96%, 97%, 98%, or 99% identical to one of these sequences, or a fragment thereof, e.g., of a sequence provided below.

The sequence of human plasma kallikrein that was used in selections and subsequent screening is shown below (accession number NP_000883.2). The human plasma kallikrein (86 kDa) that was used was purified from human plasma and activated with factor XIIa by a commercial vendor. Factor XIIa activates prekallikrein by cleaving the polypeptide sequence at a single site (between Arg371-Ile372, cleavage site marked by "/" in the sequence below) to generate active plasma kallikrein, which then consists of two disulfide linked polypeptides; a heavy chain of approximately 52 kDa and a catalytic domain of approximately 34 kDa [Colman and Schmaier, (1997) "Contact System: A Vascular Biology Modulator With Anticoagulant, Profibrinolytic, Antiadhesive, and Proinflammatory Attributes" Blood, 90, 3819-3843]

(SEQ ID NO: 1)
```
GCLTQLYENAFFRGGDVASMYTPNAQYCQMRCTFHPRCLLFSFLPASSINDMEKRFGCFLKDSVTGTLPKV

HRTGAVSGHSLKQCGHQISACHRDIYKGVDMRGVNFNVSKVSSVEECQKRCTSNIRCQFFSYATQTFHKAE

YRNNCLLKYSPGGTPTAIKVLSNVESGFSLKPCALSEIGCHMNIFQHLAFSDVDVARVLTPDAFVCRTICT

YHPNCLFFTFYTNVWKIESQRNVCLLKTSESGTPSSSTPQENTISGYSLLTCKRTLPEPCHSKIYPGVDFG

GEELNVTFVKGVNVCQETCTKMIRCQFFTYSLLPEDCKEEKCKCFLRLSMDGSPTRIAYGTQGSSGYSLRL

CNTGDNSVCTTKTSTR/IVGGTNSSWGEWPWQVSLQVKLTAQRHLCGGSLIGHQWVLTAAHCFDGLPLQDV

WRIYSGILNLSDITKDTPFSQIKEIIIHQNYKVSEGNHDIALIKLQAPLNYTEFQKPICLPSKGDTSTIYT

NCWVTGWGFSKEKGEIQNILQKVNIPLVTNEECQKRYQDYKITQRMVCAGYKEGGKDACKGDSGGPLVCKH

NGMWRLVGITSWGEGCARREQPGVYTKVAEYMDWILEKTQSSDGKAQMQSPA
```

In some embodiments, the affinity of the primate antibody for human plasma kallikrein is characterized by a $K_D$ of less than 1000, 500, 100, 10, 5, 1, 0.5 nM, e.g., less than 10 nM, less than 1 nM, or less than 0.5 nM.

In certain embodiments, the protein includes no sequences from mice or rabbits (e.g., is not a murine or rabbit antibody).

In some aspects, the disclosure provides the use of proteins (e.g., binding proteins, e.g., antibodies) (e.g., the proteins described herein) that bind to plasma kallikrein (e.g., human The human, mouse, and rat prekallikrein amino acid sequences, and the mRNA sequences encoding the same, are illustrated below. The sequences of prekallikrein are the same as plasma kallikrein, except that active plasma kallikrein (pkal) has the single polypeptide chain cleaved at a single position (indicated by the "/") to generate two chains. The sequences provided below are full sequences that include signal sequences. On secretion from the expressing cell, it is expected that the signal sequences are removed.

Human plasma kallikrein (ACCESSION: NP_000883.2)
>gi|78191798|ref|NP_000883.2| plasma kallikrein B1 precursor
[Homo sapiens]
(SEQ ID NO: 2)

MILFKQATYFISLFATVSCGCLTQLYENAFFRGGDVASMYTPNAQYCQMRCTFHPRCLLFSFLPASSIND

MEKRFGCFLKDSVTGTLPKVHRTGAVSGHSLKQCGHQISACHRDIYKGVDMRGVNFNVSKVSSVEECQKR

CTSNIRCQFFSYATQTFHKAEYRNNCLLKYSPGGTPTAIKVLSNVESGFSLKPCALSEIGCHMNIFQHLA

FSDVDVARVLTPDAFVCRTICTYHPNCLFFTFYTNVWKIESQRNVCLLKTSESGTPSSSTPQENTISGYS

LLTCKRTLPEPCHSKIYPGVDFGGEELNVTFVKGVNVCQETCTKMIRCQFFTYSLLPEDCKEEKCKCFLR

LSMDGSPTRIAYGTQGSSGYSLRLCNTGDNSVCTTKTSTRIVGGTNSSWGEWPWQVSLQVKLTAQRHLCG

GSLIGHQWVLTAAHCFDGLPLQDVWRIYSGILNLSDITKDTPFSQIKEIIIHQNYKVSEGNHDIALIKLQ

APLNYTEFQKPICLPSKGDTSTIYTNCWVTGWGFSKEKGEIQNILQKVNIPLVTNEECQKRYQDYKITQR

MVCAGYKEGGKDACKGDSGGPLVCKHNGMWRLVGITSWGEGCARREQPGVYTKVAEYMDWILEKTQSSDG

KAQMQSPA

Human plasma kallikrein mRNA (ACCESSION: NM_000892)
>gi|78191797|ref|NM_000892.3| Homo sapiens kallikrein B, plasma
(Fletcher factor) 1 (KLKB1), mRNA
(SEQ ID NO: 3)

AGAACAGCTTGAAGACCGTTCATTTTTAAGTGACAAGAGACTCACCTCCAAGAAGCAATTGTGTTTTCAG

AATGATTTTATTCAAGCAAGCAACTTATTTCATTTCCTTGTTTGCTACAGTTTCCTGTGGATGTCTGACT

CAACTCTATGAAAACGCCTTCTTCAGAGGTGGGGATGTAGCTTCCATGTACACCCCAAATGCCCAATACT

GCCAGATGAGGTGCACATTCCACCCAAGGTGTTTGCTATTCAGTTTTCTTCCAGCAAGTTCAATCAATGA

CATGGAGAAAAGGTTTGGTTGCTTCTTGAAAGATAGTGTTACAGGAACCCTGCCAAAAGTACATCGAACA

GGTGCAGTTTCTGGACATTCCTTGAAGCAATGTGGTCATCAAATAAGTGCTTGCCATCGAGACATTTATA

AAGGAGTTGATATGAGAGGAGTCAATTTTAATGTGTCTAAGGTTAGCAGTGTTGAAGAATGCCAAAAAAG

GTGCACCAGTAACATTCGCTGCCAGTTTTTTTCATATGCCACGCAAACATTTCACAAGGCAGAGTACCGG

AACAATTGCCTATTAAAGTACAGTCCCGGAGGAACACCTACCGCTATAAAGGTGCTGAGTAACGTGGAAT

CTGGATTCTCACTGAAGCCCTGTGCCCTTTCAGAAATTGGTTGCCACATGAACATCTTCCAGCATCTTGC

GTTCTCAGATGTGGATGTTGCCAGGGTTCTCACTCCAGATGCTTTTGTGTGTCGGACCATCTGCACCTAT

CACCCCAACTGCCTCTTCTTTACATTCTATACAAATGTATGGAAAATCGAGTCACAAAGAAATGTTTGTC

TTCTTAAAACATCTGAAAGTGGCACACCAAGTTCCTCTACTCCTCAAGAAAACACCATATCTGGATATAG

CCTTTTAACCTGCAAAAGAACTTTACCTGAACCCTGCCATTCTAAAATTTACCCGGGAGTTGACTTTGGA

GGAGAAGAATTGAATGTGACTTTTGTTAAAGGAGTGAATGTTTGCCAAGAGACTTGCACAAAGATGATTC

GCTGTCAGTTTTTCACTTATTCTTTACTCCCAGAAGACTGTAAGGAAGAGAAGTGTAAGTGTTTCTTAAG

ATTATCTATGGATGGTTCTCCAACTAGGATTGCGTATGGGACACAAGGGAGCTCTGGTTACTCTTTGAGA

TTGTGTAACACTGGGGACAACTCTGTCTGCACAACAAAAACAAGCACACGCATTGTTGGAGGAACAAACT

CTTCTTGGGGAGAGTGGCCCTGGCAGGTGAGCCTGCAGGTGAAGCTGACAGCTCAGAGGCACCTGTGTGG

AGGGTCACTCATAGGACACCAGTGGGTCCTCACTGCTGCCCACTGCTTTGATGGGCTTCCCCTGCAGGAT

GTTTGGCGCATCTATAGTGGCATTTTAAATCTGTCAGACATTACAAAAGATACACCTTTCTCACAAATAA

AAGAGATTATTATTCACCAAAACTATAAAGTCTCAGAAGGGAATCATGATATCGCCTTGATAAAACTCCA

GGCTCCTTTGAATTACACTGAATTCCAAAAACCAATATGCCTACCTTCCAAAGGTGACACAAGCACAATT

TATACCAACTGTTGGGTAACCGGATGGGGCTTCTCGAAGGAGAAAGGTGAAATCCAAAATATTCTACAAA

AGGTAAATATTCCTTTGGTAACAAATGAAGAATGCCAGAAAAGATATCAAGATTATAAAATAACCCAACG

GATGGTCTGTGCTGGCTATAAAGAAGGGGGAAAAGATGCTTGTAAGGGAGATTCAGGTGGTCCCTTAGTT

TGCAAACACAATGGAATGTGGCGTTTGGTGGGCATCACCAGCTGGGGTGAAGGCTGTGCCCGCAGGGAGC

-continued

```
AACCTGGTGTCTACACCAAAGTCGCTGAGTACATGGACTGGATTTTAGAGAAAACACAGAGCAGTGATGG

AAAAGCTCAGATGCAGTCACCAGCATGAGAAGCAGTCCAGAGTCTAGGCAATTTTTACAACCTGAGTTCA

AGTCAAATTCTGAGCCTGGGGGGTCCTCATCTGCAAAGCATGGAGAGTGGCATCTTCTTTGCATCCTAAG

GACGAAAAACACAGTGCACTCAGAGCTGCTGAGGACAATGTCTGGCTGAAGCCCGCTTTCAGCACGCCGT

AACCAGGGGCTGACAATGCGAGGTCGCAACTGAGATCTCCATGACTGTGTGTTGTGAAATAAAATGGTGA

AAGATCAAAAAA
```

Mouse plasma kallikrein (ACCESSION: NP_032481.1)
>gi|6680584|ref|NP_032481.1| kallikrein B, plasma 1
[*Mus musculus*]
(SEQ ID NO: 4)

```
MILFNRVGYFVSLFATVSCGCMTQLYKNTFFRGGDLAAIYTPDAQYCQKMCTFHPRCLLFSFLAVTPPKE

TNKRFGCFMKESITGTLPRIHRTGAISGHSLKQCGHQISACHRDIYKGLDMRGSNFNISKTDNIEECQKL

CTNNFHCQFFTYATSAFYRPEYRKKCLLKHSASGTPTSIKSADNLVSGFSLKSCALSEIGCPMDIFQHSA

FADLNVSQVITPDAFVCRTICTFHPNCLFFTFYTNEWETESQRNVCFLKTSKSGRPSPPIPQENAISGYS

LLTCRKTRPEPCHSKIYSGVDFEGEELNVTFVQGADVCQETCTKTIRCQFFIYSLLPQDCKEEGCKCSLR

LSTDGSPTRITYGMQGSSGYSLRLCKLVDSPDCTTKINARIVGGTNASLGEWPWQVSLQVKLVSQTHLCG

GSIIGRQWVLTAAHCFDGIPYPDVWRIYGGILSLSEITKETPSSRIKELIIHQEYKVSEGNYDIALIKLQ

TPLNYTEFQKPICLPSKADTNTIYTNCWVTGWGYTKEQGETQNILQKATIPLVPNEECQKKYRDYVINKQ

MICAGYKEGGTDACKGDSGGPLVCKHSGRWQLVGITSWGEGCGRKDQPGVYTKVSEYMDWILEKTQSSDV

RALETSSA
```

Mouse plasma kallikrein mRNA (ACCESSION: NM_008455.2)
>gi|236465804|ref|NM_008455.2| *Mus musculus* kallikrein B, plasma 1
(Klkb1), mRNA
(SEQ ID NO: 5)

```
AGACCGCCCTCGGTGCCATATTCAGAGGGCTTGAAGACCATCTTCATGTGAAGACTCCCTCTCCTCCAGA

ACCACAACGTGACCATCCTTCCAGGATGATTTTATTCAACCGAGTGGGTATTTTGTTTCCTTGTTTGCT

ACCGTCTCCTGTGGGTGTATGACTCAACTGTATAAAAATACCTTCTTCAGAGGTGGGGATCTAGCTGCCA

TCTACACCCCAGATGCCCAGTACTGTCAGAAGATGTGCACTTTTCACCCCAGGTGCCTGCTGTTCAGCTT

TCTCGCCGTGACTCCACCCAAAGAGACAAATAAACGGTTTGGTTGCTTCATGAAAGAGAGCATTACAGGG

ACTTTGCCAAGAATACACCGGACAGGGGCCATTTCTGGTCATTCTTTAAAGCAGTGTGGCCATCAAATAA

GTGCTTGCCACCGAGACATATACAAAGGACTTGATATGAGAGGGTCCAACTTTAATATCTCTAAGACCGA

CAATATTGAAGAATGCCAGAAACTGTGCACAAATAATTTTCACTGCCAATTTTTCACATATGCTACAAGT

GCATTTTACAGACCAGAGTACCGGAAGAAGTGCCTGCTGAAGCACAGTCAAGCGGAACACCCACCAGCA

TAAAGTCAGCGGACAACCTGGTGTCTGGATTCTCACTGAAGTCCTGTGCGCTTTCGGAGATAGGTTGCCC

CATGGATATTTTCCAGCACTCTGCCTTTGCAGACCTGAATGTAAGCCAGGTCATCACCCCCGATGCCTTT

GTGTGTCGCACCATCTGCACCTTCCATCCCAACTGCCTTTTCTTCACGTTCTACACGAATGAATGGGAGA

CAGAATCACAGAGAAATGTTTGTTTTCTTAAGACGTCTAAAAGTGGAAGACCAAGTCCCCCTATTCCTCA

AGAAAACGCTATATCTGGATATAGTCTCCTCACCTGCAGAAAAACTCGCCCTGAACCCTGCCATTCCAAA

ATTTACTCTGGAGTTGACTTTGAAGGGGAAGAACTGAATGTGACCTTCGTGCAAGGAGCAGATGTCTGCC

AAGAGACTTGTACAAAGACAATCCGCTGCCAGTTTTTTATTTACTCCTTACTCCCCAAGACTGCAAGGA

GGAGGGGTGTAAATGTTCCTTAAGGTTATCCACAGATGGCTCCCAACTAGGATCACCTATGGCATGCAG

GGGAGCTCCGGTTATTCTCTGAGATTGTGTAAACTTGTGGACAGCCCTGACTGTACAACAAAAATAAATG

CACGTATTGTGGGAGGAACAAACGCTTCTTTAGGGGAGTGGCCATGGCAGGTCAGCCTGCAAGTGAAGCT

GGTATCTCAGACCCATTTGTGTGGAGGGTCCATCATTGGTCGCCAATGGGTACTGACAGCTGCCCATTGC
```

-continued

```
TTTGATGGAATTCCCTATCCAGATGTGTGGCGTATATATGGCGGAATTCTTAGTCTGTCCGAGATTACGA

AAGAAACGCCTTCCTCGAGAATAAAGGAGCTTATTATTCATCAGGAATACAAAGTCTCAGAAGGCAATTA

TGATATTGCCTTAATAAAGCTTCAGACGCCCCTGAATTATACTGAATTCCAAAAACCAATATGCCTGCCT

TCCAAAGCTGACACAAATACAATTTATACCAACTGTTGGGTGACTGGATGGGGCTACACGAAGGAACAAG

GTGAAACGCAAAATATTCTACAAAAGGCTACTATTCCTTTGGTACCAAATGAAGAATGCCAGAAAAATA

CAGAGATTATGTTATAAACAAGCAGATGATCTGTGCTGGCTACAAAGAAGGCGGAACAGACGCTTGTAAG

GGAGATTCCGGTGGCCCCTTAGTCTGTAAACACAGTGGACGGTGGCAGTTGGTGGGTATCACCAGCTGGG

GTGAAGGCTGCGCCCGCAAGGACCAACCAGGAGTCTACACCAAAGTTTCTGAGTACATGGACTGGATATT

GGAGAAGACACAGAGCAGTGATGTAAGAGCTCTGGAGACATCTTCAGCCTGAGGAGGCTGGGTACCAAGG

AGGAAGAACCCAGCTGGCTTTACCACCTGCCCTCAAGGCAAACTAGAGCTCCAGGATTCTCGGCTGTAAA

ATGTTGATAATGGTGTCTACCTCACATCCGTATCATTGGATTGAAAATTCAAGTGTAGATATAGTTGCTG

AAGACAGCGTTTTGCTCAAGTGTGTTTCCTGCCTTGAGTCACAGGAGCTCCAATGGGAGCATTACAAAGA

TCACCAAGCTTGTTAGGAAAGAGAATGATCAAAGGGTTTTATTAGGTAATGAAATGTCTAGATGTGATGC

AATTGAAAAAAAGACCCCAGATTCTAGCACAGTCCTTGGGACCATTCTCATGTAACTGTTGACTCTGGAC

CTCAGCAGATCTCAGAGTTACCTGTCCACTTCTGACATTTGTTTATTAGAGCCTGATGCTATTCTTTCAA

GTGGAGC
```

Rat plasma kallikrein (ACCESSION: NP_036857.2)
>gi|162138905|ref|NP_036857.2| kallikrein B, plasma 1
[*Rattus norvegicus*]
(SEQ ID NO: 6)

```
MILFKQVGYFVSLFATVSCGCLSQLYANTFFRGGDLAAIYTPDAQHCQKMCTFHPRCLLFSFLAVSPTKE

TDKRFGCFMKESITGTLPRIHRTGAISGHSLKQCGHQLSACHQDIYEGLDMRGSNFNISKTDSIEECQKL

CTNNIHCQFFTYATKAFHRPEYRKSCLLKRSSSGTPTSIKPVDNLVSGFSLKSCALSEIGCPMDIFQHFA

FADLNVSHVVTPDAFVCRTVCTFHPNCLFFTFYTNEWETESQRNVCFLKTSKSGRPSPPIIQENAVSGYS

LFTCRKARPEPCHFKIYSGVAFEGEELNATFVQGADACQETCTKTIRCQFFTYSLLPQDCKAEGCKCSLR

LSTDGSPTRITYEAQGSSGYSLRLCKVVESSDCTTKINARIVGGTNSSLGEWPWQVSLQVKLVSQNHMCG

GSIIGRQWILTAAHCFDGIPYPDVWRIYGGILNLSEITNKTPFSSIKELIIHQKYKMSEGSYDIALIKLQ

TPLNYTEFQKPICLPSKADTNTIYTNCWVTGWGYTKERGETQNILQKATIPLVPNEECQKKYRDYVITKQ

MICAGYKEGGIDACKGDSGGPLVCKHSGRWQLVGITSWGEGCARKEQPGVYTKVAEYIDWILEKIQSSKE

RALETSPA
```

Rat plasma kallikrein mRNA (ACCESSION: NM_012725)
>gi|162138904|ref|NM_012725.2| *Rattus norvegicus* kallikrein B,
plasma 1 (Klkb1), mRNA
(SEQ ID NO: 7)

```
TGAAGACTAGCTTCATGTGAAGACTCCTTCTCCTCCAGCAGCACAAAGCAACCATCCTTCCAGGATGATT

TTATTCAAACAAGTGGGTTATTTTGTTTCCTTGTTCGCTACAGTTTCCTGTGGGTGTCTGTCACAACTGT

ATGCAAATACCTTCTTCAGAGGTGGGGATCTGGCTGCCATCTACACCCCGGATGCCCAGCACTGTCAGAA

GATGTGCACGTTTCACCCCAGGTGCCTGCTCTTCAGCTTCCTTGCCGTGAGTCCAACCAAGGAGACAGAT

AAAAGGTTTGGGTGCTTCATGAAAGAGAGCATTACAGGGACTTTGCCAAGAATACACCGGACAGGGGCCA

TTTCTGGTCATTCTTTAAAACAGTGTGGCCATCAATTAAGTGCTTGCCACCAAGACATATACGAAGGACT

GGATATGAGAGGGTCCAACTTTAATATATCTAAGACCGACAGTATTGAAGAATGCCAGAAACTGTGCACA

AATAATATTCACTGCCAATTTTTCACATATGCTACAAAAGCATTTCACAGACCAGAGTACAGGAAGAGTT

GCCTGCTGAAGCGCAGTTCAAGTGGAACGCCCACCAGTATAAAGCCAGTGGACAACCTGGTGTCTGGATT

CTCACTGAAGTCCTGTGCTCTCTCAGAGATCGGTTGCCCCATGGATATTTTCCAGCACTTTGCCTTTGCA

GACCTGAATGTAAGCCATGTCGTCACCCCCGATGCCTTCGTGTGTCGCACCGTTTGCACCTTCCATCCCA
```

-continued

```
ACTGCCTCTTCTTCACATTCTACACGAATGAGTGGGAGACGGAATCACAGAGGAATGTTTGTTTTCTTAA

GACATCTAAAAGTGGAAGACCAAGTCCCCCTATTATTCAAGAAAATGCTGTATCTGGATACAGTCTCTTC

ACCTGCAGAAAAGCTCGCCCTGAACCCTGCCATTTCAAGATTTACTCTGGAGTTGCCTTCGAAGGGAAG

AACTGAACGCGACCTTCGTGCAGGGAGCAGATGCGTGCCAAGAGACTTGTACAAAGACCATCCGCTGTCA

GTTTTTTACTTACTCATTGCTTCCCCAAGACTGCAAGGCAGAGGGGTGTAAATGTTCCTTAAGGTTATCC

ACGGATGGCTCTCCAACTAGGATCACCTATGAGGCACAGGGGAGCTCTGGTTATTCTCTGAGACTGTGTA

AAGTTGTGGAGAGCTCTGACTGTACGACAAAAATAAATGCACGTATTGTGGGAGGAACAAACTCTTCTTT

AGGAGAGTGGCCATGGCAGGTCAGCCTGCAAGTAAAGTTGGTTTCTCAGAATCATATGTGTGGAGGGTCC

ATCATTGGACGCCAATGGATACTGACGGCTGCCCATTGCTTTGATGGGATTCCCTATCCAGACGTGTGGC

GTATATATGGCGGGATTCTTAATCTGTCAGAGATTACAAACAAAACGCCTTTCTCAAGTATAAAGGAGCT

TATTATTCATCAGAAATACAAAATGTCAGAAGGCAGTTACGATATTGCCTTAATAAAGCTTCAGACACCG

TTGAATTATACTGAATTCCAAAAACCAATATGCCTGCCTTCCAAAGCTGACACAAATACAATTTATACCA

ACTGCTGGGTGACTGGATGGGCTACACAAAGGAACGAGGTGAGACCCAAAATATTCTACAAAGGCAAC

TATTCCCTTGGTACCAAATGAAGAATGCCAGAAAAAATATAGAGATTATGTTATAACCAAGCAGATGATC

TGTGCTGGCTACAAAGAAGGTGGAATAGATGCTTGTAAGGGAGATTCCGGTGGCCCCTTAGTTTGCAAAC

ATAGTGGAAGGTGGCAGTTGGTGGGTATCACCAGCTGGGCGAAGGCTGTGCCCGCAAGGAGCAACCAGG

AGTCTACACCAAAGTTGCTGAGTACATTGACTGGATATTGGAGAAGATACAGAGCAGCAAGGAAAGAGCT

CTGGAGACATCTCCAGCATGAGGAGGCTGGGTACTGATGGGAAGAGCCCAGCTGGCACCAGCTTTACCA

CCTGCCCTCAAGTCCTACTAGAGCTCCAGAGTTCTCTTCTGCAAAATGTCGATAGTGGTGTCTACCTCGC

ATCCTTACCATAGGATTAAAAGTCCAAATGTAGACACAGTTGCTAAAGACAGCGCCATGCTCAAGCGTGC

TTCCTGCCTTGAGCAACAGGAACGCCAATGAGAACTATCCAAAGATTACCAAGCCTGTTTGGAAATAAAA

TGGTCAAAGGATTTTTATTAGGTAGTGAAATTAGGTAGTTGTCCTTGGAACCATTCTCATGTAACTGTTG

ACTCTGGACCTCAGCAGATCACAGTTACCTTCTGTCCACTTCTGACATTTGTGTACTGGAACCTGATGCT

GTTCTTCCACTTGGAGCAAAGAACTGAGAAACCTGGTTCTATCCATTGGGAAAAAGAGATCTTTGTAACA

TTTCCTTTACAATAAAAAGATGTTCTACTTGGACTTGAAAAAAAAAAAAAAAAAAAAAAAAA
```

Display Libraries

A display library is a collection of entities; each entity includes an accessible polypeptide component and a recoverable component that encodes or identifies the polypeptide component. The polypeptide component is varied so that different amino acid sequences are represented. The polypeptide component can be of any length, e.g. from three amino acids to over 300 amino acids. A display library entity can include more than one polypeptide component, for example, the two polypeptide chains of a sFab. In one exemplary implementation, a display library can be used to identify proteins that bind to plasma kallikrein. In a selection, the polypeptide component of each member of the library is probed with plasma kallikrein (or fragment thereof) and if the polypeptide component binds to the plasma kallikrein, the display library member is identified, typically by retention on a support.

Retained display library members are recovered from the support and analyzed. The analysis can include amplification and a subsequent selection under similar or dissimilar conditions. For example, positive and negative selections can be alternated. The analysis can also include determining the amino acid sequence of the polypeptide component and purification of the polypeptide component for detailed characterization.

A variety of formats can be used for display libraries. Examples include the following.

Phage Display:

The protein component is typically covalently linked to a bacteriophage coat protein. The linkage results from translation of a nucleic acid encoding the protein component fused to the coat protein. The linkage can include a flexible peptide linker, a protease site, or an amino acid incorporated as a result of suppression of a stop codon. Phage display is described, for example, in U.S. Pat. No. 5,223,409; Smith (1985) Science 228:1315-1317; WO 92/18619; WO 91/17271; WO 92/20791; WO 92/15679; WO 93/01288; WO 92/01047; WO 92/09690; WO 90/02809; de Haard et al. (1999) J. Biol. Chem. 274:18218-30; Hoogenboom et al. (1998) Immunotechnology 4:1-20; Hoogenboom et al. (2000) Immunol Today 2:371-8 and Hoet et al. (2005) Nat. Biotechnol. 23(3)344-8. Bacteriophage displaying the protein component can be grown and harvested using standard phage preparatory methods, e.g. PEG precipitation from growth media. After selection of individual display phages, the nucleic acid encoding the selected protein components can be isolated from cells infected with the selected phages or from the phage themselves, after amplification. Individual colonies or plaques can be picked, the nucleic acid isolated and sequenced.

Other Display Formats.

Other display formats include cell based display (see, e.g., WO 03/029456), protein-nucleic acid fusions (see, e.g., U.S. Pat. No. 6,207,446), ribosome display (See, e.g., Mattheakis et al. (1994) Proc. Natl. Acad. Sci. USA 91:9022 and Hanes et al. (2000) Nat. Biotechnol. 18:1287-92; Hanes et al. (2000) Methods Enzymol. 328:404-30; and Schaffitzel et al. (1999) J Immunol Methods. 231(1-2):119-35), and *E. coli* periplasmic display (J Immunol Methods. 2005 Nov. 22; PMID: 16337958).

Scaffolds.

Scaffolds useful for display include: antibodies (e.g., Fab fragments, single chain Fv molecules (scFv), single domain antibodies, camelid antibodies, and camelized antibodies); T-cell receptors; MHC proteins; extracellular domains (e.g., fibronectin Type III repeats, EGF repeats); protease inhibitors (e.g., Kunitz domains, ecotin, BPTI, and so forth); TPR repeats; trifoil structures; zinc finger domains; DNA-binding proteins; particularly monomeric DNA binding proteins; RNA binding proteins; enzymes, e.g., proteases (particularly inactivated proteases), RNase; chaperones, e.g., thioredoxin and heat shock proteins; intracellular signaling domains (such as SH2 and SH3 domains); linear and constrained peptides; and linear peptide substrates. Display libraries can include synthetic and/or natural diversity. See, e.g., U.S. 2004-0005709.

Display technology can also be used to obtain binding proteins (e.g., antibodies) that bind particular epitopes of a target. This can be done, for example, by using competing non-target molecules that lack the particular epitope or are mutated within the epitope, e.g., with alanine. Such non-target molecules can be used in a negative selection procedure as described below, as competing molecules when binding a display library to the target, or as a pre-elution agent, e.g., to capture in a wash solution dissociating display library members that are not specific to the target.

Iterative Selection. In one preferred embodiment, display library technology is used in an iterative mode. A first display library is used to identify one or more binding proteins for a target. These identified binding proteins are then varied using a mutagenesis method to form a second display library. Higher affinity binding proteins are then selected from the second library, e.g., by using higher stringency or more competitive binding and washing conditions.

In some implementations, the mutagenesis is targeted to regions at the binding interface. If, for example, the identified binding proteins are antibodies, then mutagenesis can be directed to the CDR regions of the heavy or light chains as described herein. Further, mutagenesis can be directed to framework regions near or adjacent to the CDRs. In the case of antibodies, mutagenesis can also be limited to one or a few of the CDRs, e.g., to make precise step-wise improvements. Exemplary mutagenesis techniques include: error-prone PCR, recombination, DNA shuffling, site-directed mutagenesis and cassette mutagenesis.

In one example of iterative selection, the methods described herein are used to first identify a protein from a display library that binds plasma kallikrein, with at least a minimal binding specificity for a target or a minimal activity, e.g., an equilibrium dissociation constant for binding of less than 0.5 nM, 1 nM, 10 nM, or 100 nM. The nucleic acid sequences encoding the initial identified proteins are used as a template nucleic acid for the introduction of variations, e.g., to identify a second protein that has enhanced properties (e.g., binding affinity, kinetics, or stability) relative to the initial protein.

Off-Rate Selection.

Since a slow dissociation rate can be predictive of high affinity, particularly with respect to interactions between polypeptides and their targets, the methods described herein can be used to isolate binding proteins with a desired (e.g., reduced) kinetic dissociation rate for a binding interaction to a target.

To select for slow dissociating binding proteins from a display library, the library is contacted to an immobilized target. The immobilized target is then washed with a first solution that removes non-specifically or weakly bound biomolecules. Then the bound binding proteins are eluted with a second solution that includes a saturating amount of free target or a target specific high-affinity competing monoclonal antibody, i.e., replicates of the target that are not attached to the particle. The free target binds to biomolecules that dissociate from the target. Rebinding is effectively prevented by the saturating amount of free target relative to the much lower concentration of immobilized target.

The second solution can have solution conditions that are substantially physiological or that are stringent. Typically, the solution conditions of the second solution are identical to the solution conditions of the first solution. Fractions of the second solution are collected in temporal order to distinguish early from late fractions. Later fractions include biomolecules that dissociate at a slower rate from the target than biomolecules in the early fractions.

Further, it is also possible to recover display library members that remain bound to the target even after extended incubation. These can either be dissociated using chaotropic conditions or can be amplified while attached to the target. For example, phage bound to the target can be contacted to bacterial cells.

Selecting or Screening for Specificity.

The display library screening methods described herein can include a selection or screening process that discards display library members that bind to a non-target molecule. Examples of non-target molecules include streptavidin on magnetic beads, blocking agents such as bovine serum albumin, non-fat bovine milk, soy protein, any capturing or target immobilizing monoclonal antibody, or non-transfected cells which do not express the target.

In one implementation, a so-called "negative selection" step is used to discriminate between the target and related non-target molecule and a related, but distinct non-target molecule. The display library or a pool thereof is contacted to the non-target molecule. Members of the sample that do not bind the non-target are collected and used in subsequent selections for binding to the target molecule or even for subsequent negative selections. The negative selection step can be prior to or after selecting library members that bind to the target molecule.

In another implementation, a screening step is used. After display library members are isolated for binding to the target molecule, each isolated library member is tested for its ability to bind to a non-target molecule (e.g., a non-target listed above). For example, a high-throughput ELISA screen can be used to obtain this data. The ELISA screen can also be used to obtain quantitative data for binding of each library member to the target as well as for cross species reactivity to related targets or subunits of the target (e.g., plasma kallikrein) and also under different condition such as pH 6 or pH 7.5. The non-target and target binding data are compared (e.g., using a computer and software) to identify library members that specifically bind to the target.

Other Exemplary Expression Libraries

Other types of collections of proteins (e.g., expression libraries) can be used to identify proteins with a particular property (e.g., ability to bind plasma kallikrein), including, e.g., protein arrays of antibodies (see, e.g., De Wildt et al. (2000) Nat. Biotechnol. 18:989-994), lambda gt11 libraries, two-hybrid libraries and so forth.

Exemplary Libraries

It is possible to immunize a non-human primate and recover primate antibody genes that can be displayed on phage (see below). From such a library, one can select antibodies that bind the antigen used in immunization. See, for example, Vaccine. (2003) 22(2):257-67 or Immunogenetics. (2005) 57(10):730-8. Thus one could obtain primate antibodies that bind and inhibit plasma kallikrein by immunizing a chimpanzee or macaque and using a variety of means to select or screen for primate antibodies that bind and inhibit plasma kallikrein. One can also make chimeras of primatized Fabs with human constant regions, see Curr Opin Mol. Ther. (2004) 6(6):675-83. "PRIMATIZED antibodies, genetically engineered from cynomolgus macaque monkey and human components, are structurally indistinguishable from human antibodies. They may, therefore, be less likely to cause adverse reactions in humans, making them potentially suited for long-term, chronic treatment" *Curr Opin Investig Drugs.* (2001) 2(5):635-8.

One exemplary type of library presents a diverse pool of polypeptides, each of which includes an immunoglobulin domain, e.g., an immunoglobulin variable domain. Of interest are display libraries where the members of the library include primate or "primatized" (e.g., such as human, non-human primate or "humanized") immunoglobin domains (e.g., immunoglobin variable domains) or chimeric primatized Fabs with human constant regions. Human or humanized immunoglobin domain libraries may be used to identify human or "humanized" antibodies that, for example, recognize human antigens. Because the constant and framework regions of the antibody are human, these antibodies may avoid themselves being recognized and targeted as antigens when administered to humans. The constant regions may also be optimized to recruit effector functions of the human immune system. The in vitro display selection process surmounts the inability of a normal human immune system to generate antibodies against self-antigens.

A typical antibody display library displays a polypeptide that includes a VH domain and a VL domain. An "immunoglobulin domain" refers to a domain from the variable or constant domain of immunoglobulin molecules Immunoglobulin domains typically contain two β-sheets formed of about seven β-strands, and a conserved disulphide bond (see, e.g., A. F. Williams and A. N. Barclay, 1988, Ann. Rev. Immunol. 6:381-405). The display library can display the antibody as a Fab fragment (e.g., using two polypeptide chains) or a single chain Fv (e.g., using a single polypeptide chain). Other formats can also be used.

As in the case of the Fab and other formats, the displayed antibody can include one or more constant regions as part of a light and/or heavy chain. In one embodiment, each chain includes one constant region, e.g., as in the case of a Fab. In other embodiments, additional constant regions are displayed.

Antibody libraries can be constructed by a number of processes (see, e.g., de Haard et al., 1999, J. Biol. Chem. 274: 18218-30; Hoogenboom et al., 1998, Immunotechnology 4:1-20; Hoogenboom et al., 2000, Immunol. Today 21:371-378, and Hoet et al. (2005) Nat. Biotechnol. 23(3):344-8. Further, elements of each process can be combined with those of other processes. The processes can be used such that variation is introduced into a single immunoglobulin domain (e.g., VH or VL) or into multiple immunoglobulin domains (e.g., VH and VL). The variation can be introduced into an immunoglobulin variable domain, e.g., in the region of one or more of CDR1, CDR2, CDR3, FR1, FR2, FR3, and/or FR4, referring to such regions of either and both of heavy and light chain variable domains. For example, the variation(s) may be introduced into all three CDRs of a given variable domain, or into CDR1 and CDR2, e.g., of a heavy chain variable domain. Any combination is feasible. In one process, antibody libraries are constructed by inserting diverse oligonucleotides that encode CDRs into the corresponding regions of the nucleic acid. The oligonucleotides can be synthesized using monomeric nucleotides or trinucleotides. For example, Knappik et al., 2000, J. Mol. Biol. 296:57-86 describe a method for constructing CDR encoding oligonucleotides using trinucleotide synthesis and a template with engineered restriction sites for accepting the oligonucleotides.

In another process, an animal (e.g., a rodent) is immunized with plasma kallikrein. The animal is optionally boosted with the antigen to further stimulate the response. Then spleen cells are isolated from the animal, and nucleic acid encoding VH and/or VL domains is amplified and cloned for expression in the display library.

In yet another process, antibody libraries are constructed from nucleic acid amplified from naïve germline immunoglobulin genes. The amplified nucleic acid includes nucleic acid encoding the VH and/or VL domain. Sources of immunoglobulin-encoding nucleic acids are described below. Amplification can include PCR, e.g., with primers that anneal to the conserved constant region, or another amplification method.

Nucleic acid encoding immunoglobulin domains can be obtained from the immune cells of, e.g., a primate (e.g., a human), mouse, rabbit, camel, or rodent. In one example, the cells are selected for a particular property. B cells at various stages of maturity can be selected. In another example, the B cells are naïve.

In one embodiment, fluorescent-activated cell sorting (FACS) is used to sort B cells that express surface-bound IgM, IgD, or IgG molecules. Further, B cells expressing different isotypes of IgG can be isolated. In another preferred embodiment, the B or T cells are cultured in vitro. The cells can be stimulated in vitro, e.g., by culturing with feeder cells or by adding mitogens or other modulatory reagents, such as antibodies to CD40, CD40 ligand or CD20, phorbol myristate acetate, bacterial lipopolysaccharide, concanavalin A, phytohemagglutinin, or pokeweed mitogen.

In another embodiment, the cells are isolated from a subject that has a disease of condition described herein, e.g., a plasma kallikrein associated disease or condition.

In one preferred embodiment, the cells have activated a program of somatic hypermutation. Cells can be stimulated to undergo somatic mutagenesis of immunoglobulin genes, for example, by treatment with anti-immunoglobulin, anti-CD40, and anti-CD38 antibodies (see, e.g., Bergthorsdottir et al., 2001, J. Immunol. 166:2228). In another embodiment, the cells are naïve.

The nucleic acid encoding an immunoglobulin variable domain can be isolated from a natural repertoire by the following exemplary method. First, RNA is isolated from the immune cell. Full length (i.e., capped) mRNAs are separated (e.g. by degrading uncapped RNAs with calf intestinal phosphatase). The cap is then removed with tobacco acid pyrophosphatase and reverse transcription is used to produce the cDNAs.

The reverse transcription of the first (antisense) strand can be done in any manner with any suitable primer. See, e.g., de Haard et al., 1999, J. Biol. Chem. 274:18218-30. The primer binding region can be constant among different immunoglobulins, e.g., in order to reverse transcribe different isotypes of immunoglobulin. The primer binding region can also be specific to a particular isotype of immunoglobulin. Typically, the primer is specific for a region that is 3' to a sequence encoding at least one CDR. In another embodiment, poly-dT primers may be used (and may be preferred for the heavy-chain genes).

A synthetic sequence can be ligated to the 3' end of the reverse transcribed strand. The synthetic sequence can be used as a primer binding site for binding of the forward primer during PCR amplification after reverse transcription. The use of the synthetic sequence can obviate the need to use a pool of different forward primers to fully capture the available diversity.

The variable domain-encoding gene is then amplified, e.g., using one or more rounds. If multiple rounds are used, nested primers can be used for increased fidelity. The amplified nucleic acid is then cloned into a display library vector.

Secondary Screening Methods

After selecting candidate library members that bind to a target, each candidate library member can be further analyzed, e.g., to further characterize its binding properties for the target, e.g., plasma kallikrein. Each candidate library member can be subjected to one or more secondary screening assays. The assay can be for a binding property, a catalytic property, an inhibitory property, a physiological property (e.g., cytotoxicity, renal clearance, immunogenicity), a structural property (e.g., stability, conformation, oligomerization state) or another functional property. The same assay can be used repeatedly, but with varying conditions, e.g., to determine pH, ionic, or thermal sensitivities.

As appropriate, the assays can use a display library member directly, a recombinant polypeptide produced from the nucleic acid encoding the selected polypeptide, or a synthetic peptide synthesized based on the sequence of the selected polypeptide. In the case of selected Fabs, the Fabs can be evaluated or can be modified and produced as intact IgG proteins. Exemplary assays for binding properties include the following.

ELISA.

Binding proteins can be evaluated using an ELISA assay. For example, each protein is contacted to a microtitre plate whose bottom surface has been coated with the target, e.g., a limiting amount of the target. The plate is washed with buffer to remove non-specifically bound polypeptides. Then the amount of the binding protein bound to the target on the plate is determined by probing the plate with an antibody that can recognize the binding protein, e.g., a tag or constant portion of the binding protein. The antibody is linked to a detection system (e.g., an enzyme such as alkaline phosphatase or horseradish peroxidase (HRP) which produces a colorimetric product when appropriate substrates are provided).

Homogeneous Binding Assays.

The ability of a binding protein described herein to bind a target can be analyzed using a homogenous assay, i.e., after all components of the assay are added, additional fluid manipulations are not required. For example, fluorescence resonance energy transfer (FRET) can be used as a homogenous assay (see, for example, Lakowicz et al., U.S. Pat. No. 5,631,169; Stavrianopoulos, et al., U.S. Pat. No. 4,868,103). A fluorophore label on the first molecule (e.g., the molecule identified in the fraction) is selected such that its emitted fluorescent energy can be absorbed by a fluorescent label on a second molecule (e.g., the target) if the second molecule is in proximity to the first molecule. The fluorescent label on the second molecule fluoresces when it absorbs to the transferred energy. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. A binding event that is configured for monitoring by FRET can be conveniently measured through standard fluorometric detection means, e.g., using a fluorimeter. By titrating the amount of the first or second binding molecule, a binding curve can be generated to estimate the equilibrium binding constant.

Another example of a homogenous assay is ALPHASCREEN™ (Packard Bioscience, Meriden Conn.). ALPHASCREEN™ uses two labeled beads. One bead generates singlet oxygen when excited by a laser. The other bead generates a light signal when singlet oxygen diffuses from the first bead and collides with it. The signal is only generated when the two beads are in proximity. One bead can be attached to the display library member, the other to the target. Signals are measured to determine the extent of binding.

Surface Plasmon Resonance (SPR).

The interaction of binding protein and a target can be analyzed using SPR. SPR or Biomolecular Interaction Analysis (BIA) detects biospecific interactions in real time, without labeling any of the interactants. Changes in the mass at the binding surface (indicative of a binding event) of the BIA chip result in alterations of the refractive index of light near the surface (the optical phenomenon of surface plasmon resonance (SPR)). The changes in the refractivity generate a detectable signal, which are measured as an indication of real-time reactions between biological molecules. Methods for using SPR are described, for example, in U.S. Pat. No. 5,641,640; Raether, 1988, Surface Plasmons Springer Verlag; Sjolander and Urbaniczky, 1991, Anal. Chem. 63:2338-2345; Szabo et al., 1995, Curr. Opin. Struct. Biol. 5:699-705 and on-line resources provide by BIAcore International AB (Uppsala, Sweden).

Information from SPR can be used to provide an accurate and quantitative measure of the equilibrium dissociation constant ($K_D$), and kinetic parameters, including $K_{on}$ and $K_{off}$ for the binding of a binding protein to a target. Such data can be used to compare different biomolecules. For example, selected proteins from an expression library can be compared to identify proteins that have high affinity for the target or that have a slow $K_{off}$. This information can also be used to develop structure-activity relationships (SAR). For example, the kinetic and equilibrium binding parameters of matured versions of a parent protein can be compared to the parameters of the parent protein. Variant amino acids at given positions can be identified that correlate with particular binding parameters, e.g., high affinity and slow $K_{off}$. This information can be combined with structural modeling (e.g., using homology modeling, energy minimization, or structure determination by x-ray crystallography or NMR). As a result, an understanding of the physical interaction between the protein and its target can be formulated and used to guide other design processes.

Cellular Assays.

Binding proteins can be screened for ability to bind to cells which transiently or stably express and display the target of interest on the cell surface. For example, plasma kallikrein binding proteins can be fluorescently labeled and binding to plasma kallikrein in the presence of absence of antagonistic antibody can be detected by a change in fluorescence intensity using flow cytometry e.g., a FACS machine.

Other Exemplary Methods for Obtaining Plasma Kallikrein Binding Proteins

In addition to the use of display libraries, other methods can be used to obtain a plasma kallikrein binding protein (e.g., antibody). For example, plasma kallikrein protein or a fragment thereof can be used as an antigen in a non-human animal, e.g., a rodent.

In one embodiment, the non-human animal includes at least a part of a human immunoglobulin gene. For example, it is possible to engineer mouse strains deficient in mouse antibody production with large fragments of the human Ig loci. Using the hybridoma technology, antigen-specific monoclonal antibodies (Mabs) derived from the genes with the desired specificity may be produced and selected. See, e.g., XENOMOUSE™, Green et al., 1994, *Nat. Gen.* 7:13-21; U.S. 2003-0070185, WO 96/34096, published Oct. 31, 1996, and PCT Application No. PCT/US96/05928, filed Apr. 29, 1996.

In another embodiment, a monoclonal antibody is obtained from the non-human animal, and then modified, e.g., humanized or deimmunized. Winter describes a CDR-grafting method that may be used to prepare the humanized antibodies (UK Patent Application GB 2188638A, filed on Mar. 26, 1987; U.S. Pat. No. 5,225,539. All of the CDRs of a particular human antibody may be replaced with at least a portion of a non-human CDR or only some of the CDRs may be replaced with non-human CDRs. It is only necessary to replace the number of CDRs required for binding of the humanized antibody to a predetermined antigen.

Humanized antibodies can be generated by replacing sequences of the Fv variable region that are not directly involved in antigen binding with equivalent sequences from human Fv variable regions. General methods for generating humanized antibodies are provided by Morrison, S. L., 1985, Science 229:1202-1207, by Oi et al., 1986, BioTechniques 4:214, and by Queen et al. U.S. Pat. Nos. 5,585,089, 5,693,761 and 5,693,762. Those methods include isolating, manipulating, and expressing the nucleic acid sequences that encode all or part of immunoglobulin Fv variable regions from at least one of a heavy or light chain. Numerous sources of such nucleic acid are available. For example, nucleic acids may be obtained from a hybridoma producing an antibody against a predetermined target, as described above. The recombinant DNA encoding the humanized antibody, or fragment thereof, can then be cloned into an appropriate expression vector.

Reducing Immunogenicity of Plasma Kallikrein Binding Proteins

Immunoglobin plasma kallikrein binding proteins (e.g., IgG or Fab plasma kallikrein binding proteins) may be modified to reduce immunogenicity. Reduced immunogenicity is desirable in plasma kallikrein binding proteins intended for use as therapeutics, as it reduces the chance that the subject will develop an immune response against the therapeutic molecule. Techniques useful for reducing immunogenicity of plasma kallikrein binding proteins include deletion/modification of potential human T cell epitopes and "germlining" of sequences outside of the CDRs (e.g., framework and Fc).

A plasma kallikrein-binding antibody may be modified by specific deletion of human T cell epitopes or "deimmunization," e.g., by the methods disclosed in WO 98/52976 and WO 00/34317. Briefly, the heavy and light chain variable regions of an antibody are analyzed for peptides that bind to MHC Class II; these peptides represent potential T-cell epitopes (as defined in WO 98/52976 and WO 00/34317). For detection of potential T-cell epitopes, a computer modeling approach termed "peptide threading" can be applied, and in addition a database of human MHC class II binding peptides can be searched for motifs present in the VH and VL sequences, as described in WO 98/52976 and WO 00/34317. These motifs bind to any of the 18 major MHC class II DR allotypes, and thus constitute potential T cell epitopes. Potential T-cell epitopes detected can be eliminated by substituting small numbers of amino acid residues in the variable regions, or preferably, by single amino acid substitutions. As far as possible conservative substitutions are made, often but not exclusively, an amino acid common at this position in human germline antibody sequences may be used. Human germline sequences are disclosed in Tomlinson, I. A. et al., 1992, J. Mol. Biol. 227:776-798; Cook, G. P. et al., 1995, Immunol. Today Vol. 16 (5): 237-242; Chothia, D. et al., 1992, J. Mol. Bio. 227:799-817. The V BASE directory provides a comprehensive directory of human immunoglobulin variable region sequences (compiled by Tomlinson, I. A. et al. MRC Centre for Protein Engineering, Cambridge, UK). After the deimmunizing changes are identified, nucleic acids encoding $V_H$ and $V_L$ can be constructed by mutagenesis or other synthetic methods (e.g., de novo synthesis, cassette replacement, and so forth). Mutagenized variable sequence can, optionally, be fused to a human constant region, e.g., human IgG1 or κ constant regions.

In some cases a potential T cell epitope will include residues which are known or predicted to be important for antibody function. For example, potential T cell epitopes are usually biased towards the CDRs. In addition, potential T cell epitopes can occur in framework residues important for antibody structure and binding. Changes to eliminate these potential epitopes will in some cases require more scrutiny, e.g., by making and testing chains with and without the change. Where possible, potential T cell epitopes that overlap the CDRs were eliminated by substitutions outside the CDRs. In some cases, an alteration within a CDR is the only option, and thus variants with and without this substitution should be tested. In other cases, the substitution required to remove a potential T cell epitope is at a residue position within the framework that might be critical for antibody binding. In these cases, variants with and without this substitution should be tested. Thus, in some cases several variant deimmunized heavy and light chain variable regions were designed and various heavy/light chain combinations tested in order to identify the optimal deimmunized antibody. The choice of the final deimmunized antibody can then be made by considering the binding affinity of the different variants in conjunction with the extent of deimmunization, i.e., the number of potential T cell epitopes remaining in the variable region. Deimmunization can be used to modify any antibody, e.g., an antibody that includes a non-human sequence, e.g., a synthetic antibody, a murine antibody other non-human monoclonal antibody, or an antibody isolated from a display library.

Plasma kallikrein binding antibodies are "germlined" by reverting one or more non-germline amino acids in framework regions to corresponding germline amino acids of the antibody, so long as binding properties are substantially retained. Similar methods can also be used in the constant region, e.g., in constant immunoglobulin domains.

Antibodies that bind to plasma kallikrein, e.g., an antibody described herein, may be modified in order to make the variable regions of the antibody more similar to one or more germline sequences. For example, an antibody can include one, two, three, or more amino acid substitutions, e.g., in a framework, CDR, or constant region, to make it more similar to a reference germline sequence. One exemplary germlining method can include identifying one or more germline sequences that are similar (e.g., most similar in a particular database) to the sequence of the isolated antibody. Mutations (at the amino acid level) are then made in the isolated antibody, either incrementally or in combination with other mutations. For example, a nucleic acid library that includes sequences encoding some or all possible germline mutations is made. The mutated antibodies are then evaluated, e.g., to identify an antibody that has one or more additional germline residues relative to the isolated antibody and that is still useful (e.g., has a functional activity). In one embodiment, as many germline residues are introduced into an isolated antibody as possible.

In one embodiment, mutagenesis is used to substitute or insert one or more germline residues into a framework and/or constant region. For example, a germline framework and/or constant region residue can be from a germline sequence that is similar (e.g., most similar) to the non-variable region being modified. After mutagenesis, activity (e.g., binding or other functional activity) of the antibody can be evaluated to determine if the germline residue or residues are tolerated (i.e., do not abrogate activity). Similar mutagenesis can be performed in the framework regions.

Selecting a germline sequence can be performed in different ways. For example, a germline sequence can be selected if it meets a predetermined criteria for selectivity or similarity, e.g., at least a certain percentage identity, e.g., at least 75, 80, 85, 90, 91, 92, 93, 94, 95, 96, 97, 98, 99, or 99.5% identity. The selection can be performed using at least 2, 3, 5, or 10 germline sequences. In the case of CDR1 and CDR2, identifying a similar germline sequence can include selecting one such sequence. In the case of CDR3, identifying a similar germline sequence can include selecting one such sequence, but may include using two germline sequences that separately contribute to the amino-terminal portion and the carboxy-terminal portion of the sequence. In other implementations more than one or two germline sequences are used, e.g., to form a consensus sequence.

In one embodiment, with respect to a particular reference variable domain sequence, e.g., a sequence described herein, a related variable domain sequence has at least 30, 40, 50, 60, 70, 80, 90, 95 or 100% of the CDR amino acid positions that are not identical to residues in the reference CDR sequences, residues that are identical to residues at corresponding positions in a human germline sequence (i.e., an amino acid sequence encoded by a human germline nucleic acid).

In one embodiment, with respect to a particular reference variable domain sequence, e.g., a sequence described herein, a related variable domain sequence has at least 30, 50, 60, 70, 80, 90 or 100% of the FR regions identical to FR sequence from a human germline sequence, e.g., a germline sequence related to the reference variable domain sequence.

Accordingly, it is possible to isolate an antibody which has similar activity to a given antibody of interest, but is more similar to one or more germline sequences, particularly one or more human germline sequences. For example, an antibody can be at least 90, 91, 92, 93, 94, 95, 96, 97, 98, 99, or 99.5% identical to a germline sequence in a region outside the CDRs (e.g., framework regions). Further, an antibody can include at least 1, 2, 3, 4, or 5 germline residues in a CDR region, the germline residue being from a germline sequence of similar (e.g., most similar) to the variable region being modified. Germline sequences of primary interest are human germline sequences. The activity of the antibody (e.g., the binding activity as measured by $K_A$) can be within a factor or 100, 10, 5, 2, 0.5, 0.1, and 0.001 of the original antibody.

Germline sequences of human immunoglobin genes have been determined and are available from a number of sources, including the INTERNATIONAL IMMUNOGENETICS INFORMATION SYSTEM® (IMGT), and the V BASE directory (compiled by Tomlinson, I. A. et al. MRC Centre for Protein Engineering, Cambridge, UK).

Exemplary germline reference sequences for $V_{kappa}$ include: O12/O2, O18/O8, A20, A30, L14, L1, L15, L4/18a, L5/L19, L8, L23, L9, L24, L11, L12, O11/O1, A17, A1, A18, A2, A19/A3, A23, A27, A11, L2/L16, L6, L20, L25, B3, B2, A26/A10, and A14. See, e.g., Tomlinson et al., 1995, EMBO J. 14(18):4628-3.

A germline reference sequence for the HC variable domain can be based on a sequence that has particular canonical structures, e.g., 1-3 structures in the H1 and H2 hypervariable loops. The canonical structures of hypervariable loops of an immunoglobulin variable domain can be inferred from its sequence, as described in Chothia et al., 1992, J. Mol. Biol. 227:799-817; Tomlinson et al., 1992, J. Mol. Biol. 227:776-798); and Tomlinson et al., 1995, EMBO J. 14(18):4628-38. Exemplary sequences with a 1-3 structure include: DP-1, DP-8, DP-12, DP-2, DP-25, DP-15, DP-7, DP-4, DP-31, DP-32, DP-33, DP-35, DP-40, 7-2, hv3005, hv3005f3, DP-46, DP-47, DP-58, DP-49, DP-50, DP-51, DP-53, and DP-54.

Protein Production

Standard recombinant nucleic acid methods can be used to express a protein that binds to plasma kallikrein. Generally, a nucleic acid sequence encoding the protein is cloned into a nucleic acid expression vector. Of course, if the protein includes multiple polypeptide chains, each chain can be cloned into an expression vector, e.g., the same or different vectors, that are expressed in the same or different cells.

Antibody Production.

Some antibodies, e.g., Fabs, can be produced in bacterial cells, e.g., *E. coli* cells (see e.g., Nadkarni, A. et al., 2007 Protein Expr Purif 52(1):219-29). For example, if the Fab is encoded by sequences in a phage display vector that includes a suppressible stop codon between the display entity and a bacteriophage protein (or fragment thereof), the vector nucleic acid can be transferred into a bacterial cell that cannot suppress a stop codon. In this case, the Fab is not fused to the gene III protein and is secreted into the periplasm and/or media.

Antibodies can also be produced in eukaryotic cells. In one embodiment, the antibodies (e.g., scFv's) are expressed in a yeast cell such as *Pichia* (see, e.g., Powers et al., 2001, J. Immunol. Methods. 251:123-35; Schoonooghe S. et al., 2009 BMC Biotechnol. 9:70; Abdel-Salam, H A. et al., 2001 Appl Microbiol Biotechnol 56(1-2):157-64; Takahashi K. et al., 2000 Biosci Biotechnol Biochem 64(10):2138-44; Edqvist, J. et al., 1991 J Biotechnol 20(3):291-300), *Hanseula*, or *Saccharomyces*. One of skill in the art can optimize antibody production in yeast by optimizing, for example, oxygen conditions (see e.g., Baumann K., et al. 2010 BMC Syst. Biol. 4:141), osmolarity (see e.g., Dragosits, M. et al., 2010 BMC Genomics 11:207), temperature (see e.g., Dragosits, M. et al., 2009 J Proteome Res. 8(3):1380-92), fermentation conditions (see e.g., Ning, D. et al. 2005 J. Biochem. and Mol. Biol. 38(3): 294-299), strain of yeast (see e.g., Kozyr, A V et al. 2004 Mol Biol (Mosk) 38(6):1067-75; Horwitz, A H. et al., 1988 Proc Natl Acad Sci USA 85(22):8678-82; Bowdish, K. et al. 1991 J Biol Chem 266(18):11901-8), overexpression of proteins to enhance antibody production (see e.g., Gasser, B. et al., 2006 Biotechol. Bioeng. 94(2):353-61), level of acidity of the culture (see e.g., Kobayashi H., et al., 1997 FEMS Microbiol Lett 152(2):235-42), concentrations of substrates and/or ions (see e.g., Ko J H. et al., 2996 Appl Biochem Biotechnol 60(1):41-8). In addition, yeast systems can be used to produce antibodies with an extended half-life (see e.g., Smith, B J. et al. 2001 Bioconjug Chem 12(5):750-756), In one preferred embodiment, antibodies are produced in mammalian cells. Preferred mammalian host cells for expressing the clone antibodies or antigen-binding fragments thereof include Chinese Hamster Ovary (CHO cells) (including dhfr– CHO cells, described in Urlaub and ChasM, 1980, Proc. Natl. Acad. Sci. USA 77:4216-4220, used with a DHFR selectable marker, e.g., as described in Kaufman and Sharp, 1982, Mol. Biol. 159:601 621), lymphocytic cell lines, e.g., NS0 myeloma cells and SP2 cells, COS cells, HEK293T cells (J. Immunol. Methods (2004) 289(1-2):65-80), and a cell from a transgenic animal, e.g., a transgenic mammal. For example, the cell is a mammary epithelial cell.

In some embodiments, plasma kallikrein binding proteins are produced in a plant or cell-free based system (see e.g., Galeffi, P., et al., 2006 J Transl Med 4:39).

In addition to the nucleic acid sequence encoding the diversified immunoglobulin domain, the recombinant expression vectors may carry additional sequences, such as sequences that regulate replication of the vector in host cells (e.g., origins of replication) and selectable marker genes. The selectable marker gene facilitates selection of host cells into which the vector has been introduced (see e.g., U.S. Pat. Nos. 4,399, 216, 4,634,665 and 5,179,017). For example, typically the selectable marker gene confers resistance to drugs, such as G418, hygromycin or methotrexate, on a host cell into which the vector has been introduced. Preferred selectable marker genes include the dihydrofolate reductase (DHFR) gene (for use in dhfr⁻ host cells with methotrexate selection/amplification) and the neo gene (for G418 selection).

In an exemplary system for recombinant expression of an antibody, or antigen-binding portion thereof, a recombinant expression vector encoding both the antibody heavy chain and the antibody light chain is introduced into dhfr⁻ CHO cells by calcium phosphate-mediated transfection. Within the recombinant expression vector, the antibody heavy and light chain genes are each operatively linked to enhancer/promoter regulatory elements (e.g., derived from SV40, CMV, adenovirus and the like, such as a CMV enhancer/AdMLP promoter regulatory element or an SV40 enhancer/AdMLP promoter regulatory element) to drive high levels of transcription of the genes. The recombinant expression vector also carries a DHFR gene, which allows for selection of CHO cells that have been transfected with the vector using methotrexate selection/amplification. The selected transformant host cells are cultured to allow for expression of the antibody heavy and light chains and intact antibody is recovered from the culture medium. Standard molecular biology techniques are used to prepare the recombinant expression vector, transfect the host cells, select for transformants, culture the host cells and recover the antibody from the culture medium. For example, some antibodies can be isolated by affinity chromatography with a Protein A or Protein G coupled matrix.

For antibodies that include an Fc domain, the antibody production system may produce antibodies in which the Fc region is glycosylated. For example, the Fc domain of IgG molecules is glycosylated at asparagine 297 in the CH2 domain. This asparagine is the site for modification with biantennary-type oligosaccharides. It has been demonstrated that this glycosylation is required for effector functions mediated by Fcg receptors and complement C1q (Burton and Woof, 1992, Adv. Immunol. 51:1-84; Jefferis et al., 1998, Immunol. Rev. 163:59-76). In one embodiment, the Fc domain is produced in a mammalian expression system that appropriately glycosylates the residue corresponding to asparagine 297. The Fc domain can also include other eukaryotic post-translational modifications.

Antibodies can also be produced by a transgenic animal. For example, U.S. Pat. No. 5,849,992 describes a method of expressing an antibody in the mammary gland of a transgenic mammal. A transgene is constructed that includes a milk-specific promoter and nucleic acids encoding the antibody of interest and a signal sequence for secretion. The milk produced by females of such transgenic mammals includes, secreted-therein, the antibody of interest. The antibody can be purified from the milk, or for some applications, used directly.

Characterization of Plasma Kallikrein Binding Proteins $IC_{50}$ (Inhibitory Concentration 50%) and $EC_{50}$ (Effective Concentration 50%). Within a series or group of binding proteins, those having lower $IC_{50}$ or $EC_{50}$ values are considered more potent inhibitors of plasma kallikrein than those binding proteins having higher $IC_{50}$ or $EC_{50}$ values. Exemplary binding proteins have an $IC_{50}$ value of less than 800 nM, 400 nM, 100 nM, 25 nM, 5 nM, or 1 nM, e.g., as measured in an in vitro assay for inhibition of plasma kallikrein activity when the plasma kallikrein is at 2 pM.

Plasma kallikrein binding proteins may also be characterized with reference to the activity of Factor XII and HMWK (high-molecular-weight kininogen) signaling events, e.g., the production of Factor XIIa and/or bradykinin.

The binding proteins can also be evaluated for selectivity toward plasma kallikrein. For example, a plasma kallikrein binding protein can be assayed for its potency toward plasma kallikrein and a panel of kallikreins and an $IC_{50}$ value or $EC_{50}$ value can be determined for each kallikrein. In one embodiment, a compound that demonstrates a low $IC_{50}$ value or $EC_{50}$ value for the plasma kallikrein, and a higher $IC_{50}$ value or $EC_{50}$ value, e.g., at least 2-, 5-, or 10-fold higher, for another kallikrein within the test panel is considered to be selective toward plasma kallikrein.

A pharmacokinetics study in rat, mice, or monkey can be performed with plasma kallikrein binding proteins for determining plasma kallikrein half-life in the serum Likewise, the effect of the binding protein can be assessed in vivo, e.g., in an animal model for a disease (e.g., carrageenin-induced edema in rat hind paw (Winter et al. Proc Soc Exp Biol Med. 1962; 111:544-7)), for use as a therapeutic, for example, to treat a disease or condition described herein, e.g., a plasma kallikrein associated disorder.

Pharmaceutical Compositions

Proteins (e.g., binding proteins) that bind to plasma kallikrein (e.g., human plasma kallikrein and/or murine plasma kallikrein) and, e.g., include at least one immunoglobin variable region can be used in methods for treating (or preventing) a plasma kallikrein associated disease or condition. The binding proteins can be present in a composition, e.g., a pharmaceutically acceptable composition or pharmaceutical composition, which includes a plasma kallikrein-binding protein, e.g., an antibody molecule or other polypeptide or peptide identified as binding to plasma kallikrein, as described herein. The plasma kallikrein binding protein can be formulated together with a pharmaceutically acceptable carrier. Pharmaceutical compositions include therapeutic compositions and diagnostic compositions, e.g., compositions that include labeled plasma kallikrein binding proteins for in vivo imaging, and compositions that include labeled plasma kallikrein binding proteins for treating (or preventing) a plasma kallikrein associated disease.

A pharmaceutically acceptable carrier includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal, or epidermal administration (e.g., by injection or infusion), although carriers suitable for inhalation and intranasal administration are also contemplated. Depending on the route of administration, the plasma kallikrein binding protein may be coated in a material to protect the compound from the action of acids and other natural conditions that may inactivate the compound.

A pharmaceutically acceptable salt is a salt that retains the desired biological activity of the compound and does not impart any undesired toxicological effects (see e.g., Berge, S. M., et al., 1977, J. Pharm. Sci. 66:1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous, and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids, and the like. Base addition salts include those derived from alkaline earth metals, such as sodium, potassium, magnesium, calcium, and the like, as well as from nontoxic organic amines, such as N,N'-dibenzylethylenediamine, N-methylglucamine, chloroprocaine, choline, diethanolamine, ethylenediamine, procaine, and the like.

The compositions may be in a variety of forms. These include, for example, liquid, semi-solid and solid dosage forms, such as liquid solutions (e.g., injectable and infusible solutions), dispersions or suspensions, tablets, pills, powders, liposomes and suppositories. The form can depend on the intended mode of administration and therapeutic application. Many compositions are in the form of injectable or infusible solutions, such as compositions similar to those used for administration of humans with antibodies. An exemplary mode of administration is parenteral (e.g., intravenous, subcutaneous, intraperitoneal, intramuscular). In one embodiment, the plasma kallikrein binding protein is administered by intravenous infusion or injection. In another preferred embodiment, the plasma kallikrein binding protein is administered by intramuscular or subcutaneous injection.

The phrases "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

The composition can be formulated as a solution, microemulsion, dispersion, liposome, or other ordered structure suitable to high drug concentration. Sterile injectable solutions can be prepared by incorporating the binding protein in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

A plasma kallikrein binding protein can be administered by a variety of methods, although for many applications, the preferred route/mode of administration is intravenous injection or infusion. For example, for therapeutic applications, the plasma kallikrein binding protein can be administered by intravenous infusion at a rate of less than 30, 20, 10, 5, or 1 mg/min to reach a dose of about 1 to 100 mg/m$^2$ or 7 to 25 mg/m$^2$. The route and/or mode of administration will vary depending upon the desired results. In certain embodiments, the active compound may be prepared with a carrier that will protect the compound against rapid release, such as a controlled release formulation, including implants, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are available. See, e.g., Sustained and Controlled Release Drug Delivery Systems, J. R. Robinson, ed., 1978, Marcel Dekker, Inc., New York.

Pharmaceutical compositions can be administered with medical devices. For example, in one embodiment, a pharmaceutical composition disclosed herein can be administered with a device, e.g., a needleless hypodermic injection device, a pump, or implant.

In certain embodiments, a plasma kallikrein binding protein can be formulated to ensure proper distribution in vivo. For example, the blood-brain barrier (BBB) excludes many highly hydrophilic compounds. To ensure that the therapeutic compounds disclosed herein cross the BBB (if desired), they can be formulated, for example, in liposomes. For methods of manufacturing liposomes, see, e.g., U.S. Pat. Nos. 4,522,811; 5,374,548; and 5,399,331. The liposomes may comprise one or more moieties that are selectively transported into specific cells or organs, thus enhance targeted drug delivery (see, e.g., V. V. Ranade, 1989, J. Clin. Pharmacol. 29:685).

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms can be dictated by and directly dependent on (a) the unique characteristics of the active compound and the particular therapeutic effect to be achieved, and (b) the limitations inherent in the art of compounding such an active compound for the treatment of sensitivity in individuals.

An exemplary, non-limiting range for a therapeutically or prophylactically effective amount of a binding protein (e.g., an antibody) disclosed herein is 0.1-20 mg/kg, more preferably 1-10 mg/kg. An anti-plasma kallikrein antibody can be administered, e.g., by intravenous infusion, e.g., at a rate of less than 30, 20, 10, 5, or 1 mg/min to reach a dose of about 1 to 100 mg/m$^2$ or about 5 to 30 mg/m$^2$. For binding proteins smaller in molecular weight than an antibody, appropriate amounts can be proportionally less. Dosage values may vary with the type and severity of the condition to be alleviated. For a particular subject, specific dosage regimens can be adjusted over time according to the individual need and the professional judgment of the person administering or supervising the administration of the compositions.

The pharmaceutical compositions disclosed herein may include a "therapeutically effective amount" or a "prophylactically effective amount" of a plasma kallikrein binding protein disclosed herein. A "therapeutically effective amount" refers to an amount effective, at dosages and for periods of time necessary, to achieve the desired therapeutic result. A therapeutically effective amount of the composition may vary according to factors such as the disease state, age, sex, and weight of the individual, and the ability of the protein to elicit a desired response in the individual. A therapeutically effective amount is also one in which any toxic or detrimental effects of the composition are outweighed by the therapeutically beneficial effects.

A "therapeutically effective dosage" preferably modulates a measurable parameter, e.g., levels of circulating IgG antibodies by a statistically significant degree or at least about 20%, more preferably by at least about 40%, even more preferably by at least about 60%, and still more preferably by at least about 80% relative to untreated subjects. The ability of a compound to modulate a measurable parameter, e.g., a disease-associated parameter, can be evaluated in an animal model system predictive of efficacy in human disorders and conditions, e.g., a plasma kallikrein associated disease. Alternatively, this property of a composition can be evaluated by examining the ability of the compound to modulate a parameter in vitro.

A "prophylactically effective amount" refers to an amount effective, at dosages and for periods of time necessary, to achieve the desired prophylactic result. Typically, because a prophylactic dose is used in subjects prior to or at an earlier stage of disease, the prophylactically effective amount will be less than the therapeutically effective amount.

Stabilization and Retention

In one embodiment, a plasma kallikrein binding protein is physically associated with a moiety that improves its stabilization and/or retention in circulation, e.g., in blood, serum, lymph, or other tissues, e.g., by at least 1.5, 2, 5, 10, or 50 fold. For example, a plasma kallikrein binding protein can be associated with a polymer, e.g., a substantially non-antigenic polymer, such as polyalkylene oxides or polyethylene oxides. Suitable polymers will vary substantially by weight. Polymers having molecular number average weights ranging from about 200 to about 35,000 (or about 1,000 to about 15,000, and 2,000 to about 12,500) can be used. For example, a plasma kallikrein binding protein can be conjugated to a water soluble polymer, e.g., hydrophilic polyvinyl polymers, e.g., polyvinylalcohol and polyvinylpyrrolidone. A non-limiting list of such polymers include polyalkylene oxide homopolymers such as polyethylene glycol (PEG) or polypropylene glycols, polyoxyethylenated polyols, copolymers thereof and block copolymers thereof, provided that the water solubility of the block copolymers is maintained.

A plasma kallikrein binding protein can also be associated with a carrier protein, e.g., a serum albumin, such as a human serum albumin (see e.g., Smith, B J. et al., 2001 Bioconjug Chem 12(5): 750-756). For example, a translational fusion can be used to associate the carrier protein with the plasma kallikrein binding protein.

A plasma kallikrein binding protein can also be modified as a HESylation derivative. Processes for HESylation of a plasma kallikrein binding protein utilize hydroxyethyl starch to modify the protein. HESylation of a protein can extend the circulating half-life of the protein and also reduce renal clearance.

In some embodiments, the plasma kallikrein binding proteins as described herein are fused to an unstructured recombinant polymer (URP) (see e.g., U.S. Pat. No. 7,846,445, the contents of which are incorporated herein by reference in its entirety).

URPs are polypeptides composed of Gly, Ala, Ser, Thr, Glu, and Pro that have no secondary structure. In aqueous solvents, URPs are highly solvated and give the protein they are attached to an apparent molecular mass that is much larger than that of the polypeptide alone. A URP sequence can be fused to a plasma kallikrein binding protein to (i) increase circulating half-life, (ii) improve tissue selectivity, (iii) protect the binding protein from degradation, (iv) reduce immunogenicity, (v) interrupt T-cell epitopes, (vi) enhance solubility, (vii) improve pH profile and homogeneity of protein charge, (viii) improve purification properties due to a sharper pKa, (ix) improve formulation and delivery, and (x) improve protein production (see e.g., U.S. Pat. No. 7,846,445, which is incorporated herein by reference in its entirety).

In general, a URP sequence should be designed such that it lacks unintended activities such as interactions with serum proteins (e.g., antibodies). One of skill in the art can test a URP for unintended activities using e.g., an ELISA assay to detect the level of binding to an immobilized serum protein. In some embodiments, it may be desirable for a URP to interact with a serum protein (e.g., albumin) to increase the circulating half-life of the plasma kallikrein binding protein.

In general, it is desired that URP sequences behave like denatured peptide sequences under physiological conditions and as such, lack well defined secondary and tertiary structures under physiological conditions. Methods to ascertain the second and tertiary structures of a given polypeptide are known to those of skill in the art and include, but are not limited to, CD spectroscopy in the "far-UV" spectral region (190-250 nm), and computer programs or algorithms such as the Chou-Fasman algorithm (Chou, P. Y., et al. (1974) Biochemistry, 13: 222-45). URP sequences typically have a high degree of conformational flexibility under physiological conditions (e.g., pH 6.5-7.8 and 30-37° C.) and also have large hydrodynamic radii (Stokes' radius) compared to globular proteins of similar molecular weight.

In one embodiment, the URP sequences have low immunogenicity. Preferred URPs are designed to avoid formation of conformational epitopes. For example, of particular interest are URP sequences having a low tendency to adapt compactly folded conformations in aqueous solution. In particular, low immunogenicity can be achieved by choosing sequences that resist antigen processing in antigen presenting cells, choosing sequences that do not bind MHC well and/or by choosing sequences that are derived from host (e.g., human) sequences.

In some embodiments, the URP sequences have a high degree of protease resistance to extend serum half-life. URPs can also be characterized by the effect they have on a protein sequence e.g., the protein exhibits a longer serum half-life and/or higher solubility as compared to the corresponding protein that is deficient in the URP. Methods of ascertaining serum half-life are known in the art (see e.g., Alvarez, P., et al. (2004) J Biol Chem, 279: 3375-81). One can readily determine whether the resulting protein has a longer serum half-life as compared to the unmodified protein by practicing any methods available in the art or exemplified herein.

The URP can be of any length necessary to effect (a) extension of serum half-life of a protein comprising the URP;

(b) an increase in solubility of the resulting protein; (c) an increased resistance to protease; and/or (d) a reduced immunogenicity of the resulting protein that comprises the URP. In some embodiments, the URP has about 30, 40, 50, 60, 70, 80, 90, 100, 150, 200, 300, 400 or more contiguous amino acids. When incorporated into a protein, the URP can be fragmented such that the resulting protein contains multiple URPs, or multiple fragments of URPs. Some or all of these individual URP sequences may be shorter than 40 amino acids, provided that the combined length of all URP sequences in the resulting protein is at least 40 amino acids. Preferably, the resulting protein has a combined length of URP sequences exceeding 40, 50, 60, 70, 80, 90, 100, 150, 200 or more amino acids.

In some embodiments, the isoelectric point (pI) of the URP is 1.0, 1.5, 2.0, 2.5, 3.0, 3.5, 4.0, 4.5, 5.0, 5.5, 6.0, 6.5, 7.0, 7.5, 8.0, 8.5, 9.0, 9.5, 10.0, 10.5, 11.0, 11.5, 12.0, 12.5 or even 13.0.

In general, URP sequences are rich in hydrophilic amino acids and contain a low percentage of hydrophobic or aromatic amino acids. Suitable hydrophilic residues include but are not limited to glycine, serine, aspartate, glutamate, lysine, arginine, and threonine. Hydrophobic residues that are less favored in construction of URPs include tryptophan, phenylalanine, tyrosine, leucine, isoleucine, valine, and methionine. URP sequences can be rich in glycine but URP sequences can also be rich in the amino acids glutamate, aspartate, serine, threonine, alanine or proline. Thus the predominant amino acid may be G, E, D, S, T, A or P. The inclusion of proline residues tends to reduce sensitivity to proteolytic degradation.

In some embodiments, the URP sequences include hydrophilic residues to increase their solubility in water and aqueous media under physiological conditions. The inclusion of hydrophilic residues reduces the formation of aggregates in aqueous formulations and the fusion of URP sequences to other proteins or peptides (e.g., a plasma kallikrein binding protein) can enhance their solubility and reduce aggregate formation and immunogenicity.

URP sequences can be further designed to avoid amino acids that confer undesirable properties to the protein, for example, cysteine (to avoid disulfide formation and oxidation), methionine (to avoid oxidation), asparagine and glutamine (to avoid desamidation).

In some embodiments, a URP is designed to be glycine-rich (e.g., 30%, 35%, 40%, 45%, 50%, 55%, 60%, 65%, 70%, 75%, 80%, 85%, 90%, 95%, or 100% of the total amino acids are glycine). Glycine-rich URPs are contemplated for use with the methods and compositions described herein since glycine-rich peptides have an increased conformational freedom (e.g., a characteristic of denatured peptides). The length of a glycine-rich sequence can vary between about 5 amino acids and 400 amino acids. For example, the length of a single, contiguous glycine-rich sequence can contain 5, 10, 15, 20, 25, 30, 35, 40, 45, 50, 55, 60, 70, 80, 90, 100, 120, 140, 160, 180, 200, 240, 280, 320 or 400 or more amino acids. A glycine-rich sequence may comprise glycine residues at both ends.

In some embodiments, a URP sequence is optimized to enhance the selectivity of the fusion protein for a particular tissue, cell-type or cell lineage. One can also utilize such URPs to direct the resulting protein to a specific subcellular location: extracellular matrix, nucleus, cytoplasm, cytoskeleton, plasma and/or intracellular membranous structures which include, but are not limited, to coated pits, Golgi apparatus, endoplasmic reticulum, endosome, lysosome, and mitochondria. A variety of these tissue-specific, cell-type specific, subcellular location specific sequences are known and available from numerous protein databases. Such selective URP sequences can be obtained by generating libraries of random or semi-random URP sequences, injecting them into animals or patients, and determining sequences with the desired tissue selectivity in tissue samples. Sequence determination can be performed by mass spectrometry. Using similar methods one can select URP sequences that facilitate oral, buccal, intestinal, nasal, thecal, peritoneal, pulmonary, rectal, or dermal uptake.

In one embodiment, a URP sequence is rich in positively charged amino acids such as arginine or lysine, which favors cellular uptake or transport through membranes. In some embodiments, URP sequences can be designed to contain one or more protease-sensitive sequences. Such URP sequences can be cleaved once the product of the invention has reached its target location. URP sequences can be designed to carry excess negative charges by introducing aspartic acid or glutamic acid residues. Of particular interest are URPs that contain greater than 5%, greater than 6%, 7%, 8%, 9%, 10%, 15%, 30% or more glutamic acid and less than 2% lysine or arginine. Such URPs carry an excess negative charge and as a result have a tendency to adopt open conformations due to electrostatic repulsion between individual negative charges of the peptide. Such an excess negative charge leads to an effective increase in their hydrodynamic radius and as a result it can lead to reduced kidney clearance of such molecules. Thus, one can modulate the effective net charge and hydrodynamic radius of a URP sequence by controlling the frequency and distribution of negatively charged amino acids in the URP sequences.

URPs can include a repetitive amino acid sequence of the format (Motif)x in which a sequence motif forms a direct repeat (ie ABCABCABCABC) or an inverted repeat (ABC-CBAABCCBA) and the number of these repeats can be 2, 3, 4, 5, 6, 7, 8, 9, 10, 12, 14, 16, 18, 20, 22, 24, 26, 28, 30, 35, 40, 50 or more. URPs (or the repeats inside URPs) often contain only 1, 2, 3, 4, 5 or 6 different types of amino acids. URPs typically consist of repeats of human amino acid sequences that are 4, 5, 6, 7, 8, 9, 10, 11, 12, 13, 14, 15, 16, 17, 18, 19, 20, 22, 24, 26, 28, 30, 32, 34, 36 or more amino acids long, but URPs may also consist of non-human amino acid sequences that are 20, 22, 24, 26, 28, 30, 32, 34 36, 38 40, 42, 44, 46, 48, 50 amino acids long.

In one embodiment, URPs are derived from human sequences. The human genome contains many subsequences that are rich in one particular amino acid. Of particular interest are such amino acid sequences that are rich in a hydrophilic amino acid like serine, threonine, glutamate, aspartate, or glycine. Of particular interest are such subsequences that contain few hydrophobic amino acids and are predicted to be unstructured and highly soluable in an aqeuous solution. Such human subsequences can be modified to further improve their utility. Exemplary human sequences for use in designing URPs are shown herein in Tables 24 and 25.

The use of sequences from human proteins is particularly desirable in design of URPs with reduced immunogenicity in a human subject. The URP sequence can be designed to eliminate T cell epitopes to reduce immunogenicity. For instance, one can synthesize a series of semi-random sequences with amino acid compositions that favor denatured, unstructured conformations and evaluate these sequences for the presence of human T cell epitopes and whether they are human sequences. Assays for human T cell epitopes have been described (Stickler, M., et al. (2003) J Immunol Methods, 281: 95-108). One can incorporate human sequences into the design of URP sequences by oligomerizing or concatenating human sequences that have suitable amino acid compositions. These can be direct repeats or inverted repeats or mixtures of different repeats. In one embodiment, the entire URP sequence is from a human sequence.

Non-limiting examples of URPs containing repeating amino acids are: poly-glycine, poly-glutamic acid, poly-aspartic acid, poly-serine, poly-threonine, (GX)n (SEQ ID NO: 8) where G is glycine and X is serine, aspartic acid, glutamic acid, threonine, or proline and n is at least 20, (GGX)n (SEQ ID NO: 9) where X is serine, aspartic acid, glutamic acid, threonine, or proline and n is at least 13, (GGGX)n (SEQ ID NO: 10) where X is serine, aspartic acid, glutamic acid, threonine, or proline and n is at least 10, (GGGGX)n (SEQ ID NO: 11) where X is serine, aspartic acid, glutamic acid, threonine, or proline and n is at least 8, (GzX)n (SEQ ID NO: 12) where X is serine, aspartic acid, glutamic acid, threonine, or proline, n is at least 15, and z is between 1 and 20.

The number of such repeats can be any number between 10 and 100. Products of the invention may contain URP sequences that are semi-random sequences. Examples are semi-random sequences containing at least 30, 40, 50, 60 or 70% glycine in which the glycines are well dispersed and in which the total concentration of tryptophan, phenylalanine, tyrosine, valine, leucine, and isoleucine is less then 70, 60, 50, 40, 30, 20, or 10% when combined. A preferred semi-random URP sequence contains at least 40% glycine and the total concentration of tryptophan, phenylalanine, tyrosine, valine, leucine, and isoleucine is less then 10%. A more preferred random URP sequence contains at least 50% glycine and the total concentration of tryptophan, phenylalanine, tyrosine, valine, leucine, and isoleucine is less then 5%. URP sequences can be designed by combining the sequences of two or more shorter URP sequences or fragments of URP sequences. Such a combination allows one to better modulate the pharmaceutical properties of the product containing the URP sequences and it allows one to reduce the repetitiveness of the DNA sequences encoding the URP sequences, which can improve expression and reduce recombination of the URP encoding sequences.

A URP sequence can be placed at the N terminus of either the light chain (LC) or heavy chain (HC) of a plasma kallikrein binding protein and a single URP can be attached to either HC or LC at either end. For example, one could combine the VH::CDR3::JH via a linker to VL::JL to make a scFv which could then be fused to a URP.

In one embodiment, a plasma kallikrein binding protein comprises a Fab fragment that inhibits plasma kallikrein and does not bind plasma prekallikrein wherein the LC is fused to a URP of 100 or more (e.g., 120, 140, 160, 180, 200, 300, 400 or more) amino acids and the HC is fused to a URP of 200 or more amino acids (e.g., 220, 240, 260, 280, 300, 350, 400, 450, 500, 600 or more). In one embodiment, the URP is fused to the carboxy terminus of LC and the carboxy terminus of HC. In one embodiment, the URPs have essentially equal amounts of Gly, Ala, Ser, Thr, Glu, and Pro residues. In one embodiment, the URP sequence does not comprise a hexamer repeat. In one embodiment, the plasma kallikrein binding protein (e.g., Fab fragment) is selected from the group consisting of M162-A04, M142-H08, X63-G06, X81-B01, X67-D03, X67-G04, and M160-G12.

In one embodiment, the HC::URP2 and LC::URP1 are produced in a yeast strain such as *Pichia pastoris* (BMC Biotechnol. 2009 Aug. 11; 9:70. PMID 19671134; J Biochem Mol. Biol. 2005 May 31; 38(3):294-9. PMID 15943904; Biotechnol Bioeng. 2006 Jun. 5; 94(2):353-61. PMID 16570317), *Saccharomyces cerevisiae* (BMC Syst Biol. 2010 Oct. 22; 4:141. PMID 20969759; BMC Genomics. 2010 Mar. 26; 11:207. PMID 20346137), or *Hansenula polymorpha* (Appl Microbiol Biotechnol. 2001 July; 56(1-2):157-64. PMID 11499924). One of skill in the art can utilize appropriate promoters and signal sequences for a particular strain of yeast desired for use in producing a fusion protein comprising a plasma kallikrein binding protein and a URP polypeptide.

In one embodiment, the HC::URP2 and LC::URP1 are produced in mammalian cells such as Chinese hamster ovary (CHO) cells. Signal sequences and promoters that are useful for protein production using CHO cells are known in the literature.

Kits

A plasma kallikrein binding protein described herein can be provided in a kit, e.g., as a component of a kit. For example, the kit includes (a) a plasma kallikrein binding protein, e.g., a composition (e.g., a pharmaceutical composition) that includes a plasma kallikrein binding protein, and, optionally (b) informational material. The informational material can be descriptive, instructional, marketing or other material that relates to a method described herein and/or the use of a plasma kallikrein binding protein, e.g., for a method described herein.

The informational material of the kit is not limited in its form. In one embodiment, the informational material can include information about production of the compound, molecular weight of the compound, concentration, date of expiration, batch or production site information, and so forth. In one embodiment, the informational material relates to using the binding protein to treat, prevent, or diagnosis of disorders and conditions, e.g., a plasma kallikrein associated disease or condition.

In one embodiment, the informational material can include instructions to administer a plasma kallikrein binding protein in a suitable manner to perform the methods described herein, e.g., in a suitable dose, dosage form, or mode of administration (e.g., a dose, dosage form, or mode of administration described herein). In another embodiment, the informational material can include instructions to administer a plasma kallikrein binding protein to a suitable subject, e.g., a human, e.g., a human having, or at risk for, a disorder or condition described herein, e.g., a plasma kallikrein associated disease or condition. For example, the material can include instructions to administer a plasma kallikrein binding protein to a patient with a disorder or condition described herein, e.g., a plasma kallikrein associated disease. The informational material of the kits is not limited in its form. In many cases, the informational material, e.g., instructions, is provided in print but may also be in other formats, such as computer readable material.

A plasma kallikrein binding protein can be provided in any form, e.g., liquid, dried or lyophilized form. It is preferred that a plasma kallikrein binding protein be substantially pure and/or sterile. When a plasma kallikrein binding protein is provided in a liquid solution, the liquid solution preferably is an aqueous solution, with a sterile aqueous solution being preferred. When a plasma kallikrein binding protein is provided as a dried form, reconstitution generally is by the addition of a suitable solvent. The solvent, e.g., sterile water or buffer, can optionally be provided in the kit.

The kit can include one or more containers for the composition containing a plasma kallikrein binding protein. In some embodiments, the kit contains separate containers, dividers or compartments for the composition and informational material. For example, the composition can be contained in a bottle, vial, or syringe, and the informational material can be contained in association with the container. In other embodiments, the separate elements of the kit are contained within a single, undivided container. For example, the composition is contained in a bottle, vial or syringe that has attached thereto the informational material in the form of a label. In some embodiments, the kit includes a plurality (e.g., a pack) of individual containers, each containing one or more unit dosage forms (e.g., a dosage form described herein) of a plasma kallikrein binding protein. For example, the kit includes a plurality of syringes, ampules, foil packets, or blister packs, each containing a single unit dose of a plasma kallikrein binding protein. The containers of the kits can be air tight, waterproof (e.g., impermeable to changes in moisture or evaporation), and/or light-tight.

The kit optionally includes a device suitable for administration of the composition, e.g., a syringe, inhalant, dropper (e.g., eye dropper), swab (e.g., a cotton swab or wooden swab), or any such delivery device. In one embodiment, the device is an implantable device that dispenses metered doses of the binding protein. The disclosure also features a method of providing a kit, e.g., by combining components described herein.

Treatments

Proteins that bind to plasma kallikrein, e.g., as described herein, have therapeutic and prophylactic utilities, particularly in human subjects. These binding proteins are administered to a subject to treat, prevent, and/or diagnose a variety of disorders and conditions, including e.g., a plasma kallikrein associated disease, or even to cells in culture, e.g., in vitro or ex vivo. For example, these binding proteins can be used to modify the effects of plasma kallikrein released from cells in culture (Lilla et al., J Biol. Chem. 284(20):13792-13803 (2009)). Treating includes administering an amount effective to alleviate, relieve, alter, remedy, ameliorate, improve or affect the disorder, the symptoms of the disorder or the predisposition toward the disorder. The treatment may also delay onset, e.g., prevent onset, or prevent deterioration of a disease or condition.

As used herein, an amount of a target-binding agent effective to prevent a disorder, or a prophylactically effective amount of the binding agent refers to an amount of a target binding agent, e.g., an plasma kallikrein binding protein, e.g., an anti-plasma kallikrein antibody described herein, which is effective, upon single- or multiple-dose administration to the subject, for preventing or delaying the occurrence of the onset or recurrence of a disorder, e.g., a disorder described herein, e.g., a plasma kallikrein associated disease.

Methods of administering plasma kallikrein binding proteins and other agents are also described in "Pharmaceutical Compositions." Suitable dosages of the molecules used can depend on the age and weight of the subject and the particular drug used. The binding proteins can be used as competitive agents to inhibit, reduce an undesirable interaction, e.g., between plasma kallikrein and its substrate (e.g., Factor XII or HMWK). The dose of the plasma kallikrein binding protein can be the amount sufficient to block 90%, 95%, 99%, or 99.9% of the activity of plasma kallikrein in the patient, especially at the site of disease. Depending on the disease, this may require 0.1, 1.0, 3.0, 6.0, or 10.0 mg/Kg. For an IgG having a molecular mass of 150,000 g/mole (two binding sites), these doses correspond to approximately 18 nM, 180 nM, 540 nM, 1.08 µM, and 1.8 µM of binding sites for a 5 L blood volume.

In one embodiment, the plasma kallikrein binding proteins are used to inhibit an activity (e.g., inhibit at least one activity of plasma kallikrein, e.g., reduce Factor XIIa and/or bradykinin production) of plasma kallikrein, e.g., in vivo. The binding proteins can be used by themselves or conjugated to an agent, e.g., a cytotoxic drug, cytotoxin enzyme, or radioisotope. This method includes: administering the binding protein alone or attached to an agent (e.g., a cytotoxic drug), to a subject requiring such treatment. For example, plasma kallikrein binding proteins that do not substantially inhibit plasma kallikrein may be used to deliver nanoparticles containing agents, such as toxins, to plasma kallikrein associated cells or tissues, e.g., to treat a plasma kallikrein-associate disorder.

Because the plasma kallikrein binding proteins recognize plasma kallikrein expressing cells and can bind to cells that are associated with (e.g., in proximity of or intermingled with) a plasma kallikrein associated disorder or condition, plasma kallikrein binding proteins can be used to inhibit an activity (e.g., inhibit at least one activity of plasma kallikrein, e.g., reduce Factor XIIa and/or bradykinin production) any such cells and inhibit the plasma kallikrein associated disease. Reducing plasma kallikrein activity can indirectly inhibit cells which may be dependent on the plasma kallikrein activity for the development and/or progression of a plasma kallikrein-associated disorder.

The binding proteins may be used to deliver an agent (e.g., any of a variety of cytotoxic and therapeutic drugs) to cells and tissues where plasma kallikrein is present. Exemplary agents include a compound emitting radiation, molecules of plants, fungal, or bacterial origin, biological proteins, and mixtures thereof. The cytotoxic drugs can be intracellularly acting cytotoxic drugs, such as toxins short range radiation emitters, e.g., short range, high energy α-emitters.

To target plasma kallikrein expressing cells, a prodrug system can be used. For example, a first binding protein is conjugated with a prodrug which is activated only when in close proximity with a prodrug activator. The prodrug activator is conjugated with a second binding protein, preferably one which binds to a non competing site on the target molecule. Whether two binding proteins bind to competing or non competing binding sites can be determined by conventional competitive binding assays. Exemplary drug prodrug pairs are described in Blakely et al., (1996) Cancer Research, 56:3287 3292.

The plasma kallikrein binding proteins can be used directly in vivo to eliminate antigen-expressing cells via natural complement-dependent cytotoxicity (CDC) or antibody dependent cellular cytotoxicity (ADCC). The binding proteins described herein can include complement binding effector domain, such as the Fc portions from IgG1, -2, or -3 or corresponding portions of IgM which bind complement. In one embodiment, a population of target cells is ex vivo treated with a binding agent described herein and appropriate effector cells. The treatment can be supplemented by the addition of complement or serum containing complement. Further, phagocytosis of target cells coated with a binding protein described herein can be improved by binding of complement proteins. In another embodiment target, cells coated with the binding protein which includes a complement binding effector domain are lysed by complement.

Methods of administering plasma kallikrein binding proteins are described in "Pharmaceutical Compositions." Suitable dosages of the molecules used will depend on the age and weight of the subject and the particular drug used. The binding proteins can be used as competitive agents to inhibit or reduce an undesirable interaction, e.g., between a natural or pathological agent and the plasma kallikrein.

The plasma kallikrein binding protein can be used to deliver macro and micromolecules, e.g., a gene into the cell for gene therapy purposes into the endothelium or epithelium and target only those tissues expressing the plasma kallikrein. The binding proteins may be used to deliver a variety of cytotoxic drugs including therapeutic drugs, a compound emitting radiation, molecules of plants, fungal, or bacterial origin, biological proteins, and mixtures thereof. The cytotoxic drugs can be intracellularly acting cytotoxic drugs, such as short range radiation emitters, including, for example, short range, high energy α emitters, as described herein.

In the case of polypeptide toxins, recombinant nucleic acid techniques can be used to construct a nucleic acid that encodes the binding protein (e.g., antibody or antigen-binding fragment thereof) and the cytotoxin (or a polypeptide component thereof) as translational fusions. The recombinant nucleic acid is then expressed, e.g., in cells and the encoded fusion polypeptide isolated.

Alternatively, the plasma kallikrein binding protein can be coupled to high energy radiation emitters, for example, a radioisotope, such as $^{131}$I, a γ-emitter, which, when localized at a site, results in a killing of several cell diameters. See, e.g., S. E. Order, "Analysis, Results, and Future Prospective of the Therapeutic Use of Radiolabeled Antibody in Cancer Therapy", *Monoclonal Antibodies for Cancer Detection and Therapy*, R. W. Baldwin et al. (eds.), pp 303 316 (Academic Press 1985). Other suitable radioisotopes include a emitters, such as $^{212}$Bi, $^{213}$Bi, and $^{211}$At, and b emitters, such as $^{186}$Re and $^{90}$Y. Moreover, $^{177}$Lu may also be used as both an imaging and cytotoxic agent.

Radioimmunotherapy (RIT) using antibodies labeled with $^{131}$I, $^{90}$Y and $^{177}$Lu is under intense clinical investigation. There are significant differences in the physical characteristics of these three nuclides and as a result, the choice of radionuclide is very critical in order to deliver maximum radiation dose to a tissue of interest. The higher beta energy particles of $^{90}$Y may be good for bulky tumors. The relatively low energy beta particles of $^{131}$I are ideal, but in vivo dehalogenation of radioiodinated molecules is a major disadvantage for internalizing antibody. In contrast, $^{177}$Lu has low energy beta particle with only 0.2-0.3 mm range and delivers much lower radiation dose to bone marrow compared to $^{90}$Y. In addition, due to longer physical half-life (compared to $^{90}$Y), the residence times are higher. As a result, higher activities (more mCi amounts) of $^{177}$Lu labeled agents can be administered with comparatively less radiation dose to marrow. There have been several clinical studies investigating the use of $^{177}$Lu labeled antibodies in the treatment of various cancers. (Mulligan T et al., 1995, *Clin. Canc. Res.* 1: 1447-1454; Meredith R F, et al., 1996, *J. Nucl. Med.* 37:1491-1496; Alvarez R D, et al., 1997, *Gynecol. Oncol.* 65: 94-101).

Exemplary Diseases and Conditions

A plasma kallikrein binding protein described herein is useful to treat (or prevent) a disease or condition in which plasma kallikrein activity is implicated, e.g., a disease or condition described herein, or to treat (or prevent) one or more symptoms associated therewith. In some embodiments, the plasma kallikrein binding protein (e.g., plasma kallikrein binding IgG or Fab) inhibits plasma kallikrein activity.

Examples of such diseases and conditions which can be treated (or prevented) by a plasma kallikrein binding protein described herein include: rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, edema, hereditary angioedema, cerebral edema, pulmonary embolism, stroke, clotting induced by ventricular assistance devices or stents, head trauma or peri-tumor brain edema, sepsis, acute middle cerebral artery (MCA) ischemic event (stroke), restenosis (e.g., after angioplasty), systemic lupus erythematosis nephritis, and burn injury. A plasma kallikrein binding protein described herein can also be used to promote wound healing. A plasma kallikrein binding protein described herein can also be used as an oncology treatment by mechanisms that include, but are not limited to, blocking production of pro-angiogenic bradykinin A therapeutically effective amount of a plasma kallikrein binding protein can be administered to a subject having or suspected of having a disorder in which plasma kallikrein activity is implicated, thereby treating (e.g., ameliorating or improving a symptom or feature of a disorder, slowing, stabilizing and/or halting disease progression) the disorder.

The plasma kallikrein binding protein can be administered in a therapeutically effective amount. A therapeutically effective amount of a plasma kallikrein binding protein is the amount which is effective, upon single or multiple dose administration to a subject, in treating a subject, e.g., curing, alleviating, relieving or improving at least one symptom of a disorder in a subject to a degree beyond that expected in the absence of such treatment. A therapeutically effective amount of the composition may vary according to factors such as the disease state, age, sex, and weight of the individual, and the ability of the compound to elicit a desired response in the individual. A therapeutically effective amount is also one in which any toxic or detrimental effects of the composition are outweighed by the therapeutically beneficial effects. A therapeutically effective dosage preferably modulates a measurable parameter, favorably, relative to untreated subjects. The ability of a compound to affect (e.g., inhibit) a measurable parameter can be evaluated in an animal model system predictive of efficacy in a human disorder.

Dosage regimens can be adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

Rheumatoid Arthritis

Rheumatoid arthritis (RA) is an autoimmune, chronic inflammatory disease that causes joint swelling and pain and normally results in joint destruction. RA generally follows a relapsing/remitting course, with "flares" of disease activity interspersed with remissions of disease symptoms. RA is associated with a number of additional inflammatory disorders, including Sjogren's syndrome (dry eyes and mouth caused by inflammation of tear and saliva glands), pleuritis (inflammation of the pleura that causes pain upon deep breath and coughing), rheumatoid nodules (nodular sites of inflammation that develop within the lungs), pericarditis (inflammation of the pericardium that causes pain when lying down or leaning forward), Felty syndrome (splenomegaly and leucopenia observed in conjunction with RA, making the subject prone to infection), and vasculitis (an inflammation of the blood vessels which can block blood flow). Plasma kallikrein has been implicated in rheumatoid arthritis.

Symptoms of active RA include fatigue, lack of appetite, low grade fever, muscle and joint aches, and stiffness. Muscle and joint stiffness are usually most notable in the morning and after periods of inactivity. During flares, joints frequently become red, swollen, painful, and tender, generally as a consequence of synovitis.

Treatment for rheumatoid arthritis involves a combination of medications, rest, joint strengthening exercises, and joint protection. Two classes of medications are used in treating rheumatoid arthritis: anti-inflammatory "first-line drugs," and "Disease-Modifying Antirheumatic Drugs" (DMARDs). The first-line drugs include NSAIDS (e.g., aspirin, naproxen, ibuprofen, and etodolac) and cortisone (corticosteroids). DMARDs, such as gold (e.g., gold salts, gold thioglucose, gold thiomalate, oral gold), methotrexate, sulfasalazine, D-penicillamine, azathioprine, cyclophosphamide, chlorambucil, and cyclosporine, leflunomide, etanercept, infliximab, anakinra, and adalimumab, and hydroxychloroquine, promote disease remission and prevent progressive joint destruction, but they are not anti-inflammatory agents.

The disclosure provides methods of treating (e.g., ameliorating, stabilizing, or eliminating one or more symptoms or ameliorating or stabilizing the subject's score on a RA scale) rheumatoid arthritis by administering a plasma kallikrein binding protein (e.g., a therapeutically effective amount of a plasma kallikrein binding protein) to a subject having or suspected of having RA. Additionally provided are methods of treating RA by administering a plasma kallikrein binding protein (e.g., a therapeutically effective amount of a plasma kallikrein binding protein) in combination with a second therapy, e.g., with at least one anti-inflammatory "first line drug" (e.g., an NSAID and/or cortisone) and/or a DMARD. The disclosure also provides methods of preventing rheumatoid arthritis or a symptom thereof by administering a plasma kallikrein binding protein (e.g., a prophylactically effective amount of a plasma kallikrein binding protein) to a subject at risk of developing RA (e.g., a subject having a family member with RA or a genetic predisposition thereto).

Further provided are methods of treating (e.g., ameliorating, stabilizing, or eliminating one or more symptoms) rheumatoid arthritis associated disorders (Sjogren's syndrome, pleuritis, pulmonary rheumatoid nodules, pericarditis, Felty syndrome, and vasculitis) by administering a plasma kallikrein binding protein (e.g., a therapeutically effective amount of a plasma kallikrein binding protein) to a subject having or suspected of having RA.

Scales useful for assessing RA and symptoms of RA include, e.g., the Rheumatoid Arthritis Severity Scale (RASS; Bardwell et al., (2002) *Rheumatology* 41(1):38-45), SF-36 Arthritis Specific Health Index (ASHI; Ware et al., (1999) *Med. Care.* 37(5 Suppl):MS40-50), Arthritis Impact Measurement Scales or Arthritis Impact Measurement Scales 2 (AIMS or AIMS2; Meenan et al. (1992) *Arthritis Rheum.* 35(1):1-10); the Stanford Health Assessment Questionnaire (HAQ), HAQII, or modified HAQ (see, e.g., Pincus et al. (1983) *Arthritis Rheum.* 26(11):1346-53).

Guidance for the determination of the dosage that delivers a therapeutically effective amount of a plasma kallikrein binding protein may be obtained from animal models of rheumatoid arthritis, such as collagen-induced arthritis (CIA), which is induced, typically in rodents, by immunization with autologous or heterologous type II collagen in adjuvant (Williams et al. Methods Mol. Med. 98:207-16 (2004)).

Gout

Gout is a condition that results from crystals of uric acid depositing in tissues of the body. Gout is characterized by an overload of uric acid in the body and recurring attacks of joint inflammation (arthritis). Chronic gout can lead to deposits of hard lumps of uric acid in and around the joints, decreased kidney function, and kidney stones. Gout is often related to an inherited abnormality in the body's ability to process uric acid. Uric acid is a breakdown product of purines, which are part of many foods. An abnormality in handling uric acid can cause attacks of painful arthritis (gout attack), kidney stones, and blockage of the kidney filtering tubules with uric acid crystals, leading to kidney failure. Some patients may only develop elevated blood uric acid levels (hyperuricemia) without having arthritis or kidney problems.

Symptoms of gout include, e.g., excruciating and unexpected pain, swelling, redness, warmth and stiffness in the affected foot or other parts of the body, and low-grade fever.

Treatments for gout include, e.g., nonsteroidal anti-inflammatory drugs (NSAIDs), colchicine and oral glucocorticoids, intra-articular glucocorticoids administered via a joint injection, xanthine oxidase inhibitors (e.g., allopurinol, febuxostat), uricosurics (e.g., probenecid, EDTA), urate oxidases (e.g., pegloticase), sodium bicarbonate, and low purine diet.

The disclosure provides methods of treating (e.g., ameliorating, stabilizing, or eliminating one or more symptoms or the worsening of) gout by administering a plasma kallikrein binding protein (e.g., a therapeutically effective amount of a plasma kallikrein binding protein) to a subject having or suspected of having gout. Additionally provided are methods of treating gout by administering a plasma kallikrein binding protein (e.g., a therapeutically effective amount of a kallikrein binding protein) in combination with a second therapy, e.g., an NSAID, a colchicine, an oral glucocorticoid, an intra-articular glucocorticoid administered via a joint injection, a xanthine oxidase inhibitor (e.g., allopurinol, febuxostat), a uricosuric (e.g., probenecid, EDTA), a urate oxidase (e.g., pegloticase), sodium bicarbonate, and/or low purine diet. The disclosure also provides methods of preventing gout or a symptom thereof by administering a plasma kallikrein binding protein (e.g., a prophylactically effective amount of a plasma kallikrein binding protein) to a subject at risk of developing gout (e.g., a subject having a family member with gout or a genetic predisposition thereto).

Guidance for the determination of the dosage that delivers a therapeutically effective amount of a plasma kallikrein binding protein may be obtained from animal models of gout, see, e.g., Reginato and Olsen, Curr Opin Rheumatol. 19(2): 134-45 (2007) and references cited therein.

Intestinal Bowel Disease (IBD)

Inflammatory bowel disease (IBD) is a group of inflammatory conditions of the large intestine and, in some cases, the small intestine. The main forms of IBD are Crohn's disease and ulcerative colitis (UC). Accounting for far fewer cases are other forms of IBD: collagenous colitis, lymphocytic colitis, ischaemic colitis, diversion colitis, Behçet's syndrome, infective colitis, and indeterminate colitis. The main difference between Crohn's disease and UC is the location and nature of the inflammatory changes. Crohn's can affect any part of the gastrointestinal tract, from mouth to anus (skip lesions), although a majority of the cases start in the terminal ileum. Ulcerative colitis, in contrast, is restricted to the colon and the rectum. Microscopically, ulcerative colitis is restricted to the mucosa (epithelial lining of the gut), while Crohn's disease affects the whole bowel wall. Finally, Crohn's disease and ulcerative colitis present with extra-intestinal manifestations (such as liver problems, arthritis, skin manifestations and eye problems) in different proportions.

Symptoms of IBD include abdominal pain, vomiting, diarrhea, hematochezia, weight loss, weight gain and various associated complaints or diseases (arthritis, pyoderma gangrenosum, primary sclerosing cholangitis). Diagnosis is generally by colonoscopy with biopsy of pathological lesions. Rarely, a definitive diagnosis of neither Crohn's disease nor ulcerative colitis can be made because of idiosyncrases in the presentation. In this case, a diagnosis of indeterminate colitis may be made.

Treatment for IBD, depending on the level of severity, may require immunosuppression to control the symptoms. Immunosuppresives such as azathioprine, methotrexate, or 6-mercaptopurine can be used. More commonly, treatment of IBD requires a form of mesalamine. Often, steroids are used to control disease flares and were once acceptable as a maintenance drug. Biologicals, such as infliximab, have been used to treat patients with Crohn's disease or Ulcerative Colitis. Severe cases may require surgery, such as bowel resection, strictureplasty or a temporary or permanent colostomy or ileostomy. Alternative medicine treatments for IBD exist in various forms however such methods concentrate on controlling underlying pathology in order to avoid prolonged steroidal exposure or surgical excision. Usually the treatment is started by administering drugs, such as prednisone, with high anti-inflammatory affects. Once the inflammation is successfully controlled, the patient is usually switched to a lighter drug, such as asacol—a mesalamine—to keep the disease in remission. If unsuccessful, a combination of the aforementioned immunosuppressant drugs with a mesalamine (which may also have an anti-inflammatory effect) may or may not be administered, depending on the patient.

The disclosure provides methods of treating (e.g., ameliorating, stabilizing, or eliminating one or more symptoms of) IBD by administering a plasma kallikrein binding protein (e.g., a therapeutically effective amount of a plasma kallikrein binding protein) to a subject having or suspected of having IBD. Additionally provided are methods of treating IBD by administering a plasma kallikrein binding protein (e.g., a therapeutically effective amount of a kallikrein binding protein) in combination with a second therapy, e.g., an immunosuppressive (e.g., azathioprine, methotrexate, 6-mercaptopurine), a mesalamine, a steroid, and/or infliximab. The disclosure also provides methods of preventing IBD or a symptom thereof by administering a plasma kallikrein binding protein (e.g., a prophylactically effective amount of a plasma kallikrein binding protein) to a subject at risk of developing IBD (e.g., a subject having a family member with IBD or a genetic predisposition thereto).

Guidance for the determination of the dosage that delivers a therapeutically effective amount of a plasma kallikrein binding protein may be obtained from animal models of IBD, see, e.g., those described in U.S. Pat. No. 6,114,382, WO 2004/071186, and references cited therein.

Oral Mucositis

Oral mucositis is the painful inflammation and ulceration of the mucous membranes in the mouth, usually as an adverse effect of chemotherapy and radiotherapy treatment for cancer.

Symptoms of oral mucositis include, e.g., ulcers, peripheral erythema, burning sensation accompanied by reddening, trouble speaking, eating, or even opening the mouth, and dyseusia (alteration in taste perception).

Treatment for oral mucositis includes oral hygiene (salt mouthwash, GELCLAIR®, CAPHOSOL®, MUGARD®), palifermin (a human keratinocyte growth factor), cytokines and other modifiers of inflammation (e.g., IL-1, IL-11, TGF-beta3), amino acid supplementation (e.g., glutamine), vitamins, colony-stimulating factors, cryotherapy, and laser therapy.

The disclosure provides methods of treating (e.g., ameliorating, reducing, or eliminating one or more symptoms, or stabilizing the subject's score on a mucositis scale) oral mucositis by administering a plasma kallikrein binding protein (e.g., a therapeutically effective amount of a plasma kallikrein binding protein) to a subject having or suspected of having oral mucositis. Additionally provided are methods of treating oral mucositis by administering a plasma kallikrein binding protein (e.g., a therapeutically effective amount of a plasma kallikrein binding protein) in combination with a second therapy, e.g., oral hygiene (salt mouthwash, GELCLAIR®, CAPHOSOL®, MUGARD®), palifermin (a human keratinocyte growth factor), a cytokine and/or a modifier of inflammation (e.g., IL-1, IL-11, TGF-beta3), an amino acid supplementation (e.g., glutamine), a vitamin, a colony-stimulating factor, cryotherapy, and/or laser therapy. The disclosure also provides methods of preventing oral mucositis or a symptom thereof by administering a plasma kallikrein binding protein (e.g., a prophylactically effective amount of a plasma kallikrein binding protein) to a subject at risk of developing oral mucositis (e.g., a subject that has undergone or is undergoing chemotherapy or radiotherapy).

Scales useful for assessing oral mucositis include the World Health Organization (WHO) Oral Toxicity score (Handbook for reporting results of cancer treatment. Geneva, Switzerland: World Health Organization; 1979:15-22), National Cancer Institute Common Toxicity Criteria (NCI-CTC) for Oral Mucositis (National Cancer Institute Common Toxicity Criteria. Version 2.0, Jun. 1, 1999, Sonis et al., Cancer. 85:2103-2113 (1999)), and Oral Mucositis Assessment Scale (OMAS).

Guidance for the determination of the dosage that delivers a therapeutically effective amount of a plasma kallikrein binding protein may be obtained from animal models of oral mucositis, such as an animal model of oral mucositis induced by conditioning regimen of haematopoietic stem cell transplantation (Chen et al., Zhonghua Kou Qiang Yi Xue Za Zhi. 42(11):672-6 (2007)).

Neuropathic Pain

Neuropathic pain is a complex, chronic pain state that usually is accompanied by tissue injury. With neuropathic pain, the nerve fibers themselves may be damaged, dysfunctional or injured. These damaged nerve fibers send incorrect signals to other pain centers. The impact of nerve fiber injury includes a change in nerve function both at the site of injury and areas around the injury.

Symptoms of neuropathic pain include, e.g., shooting and burning pain and tingling and numbness.

Treatments for neuropathic pain include, e.g., medications (e.g., non-steroidal anti-inflammatory drugs (NSAIDs) (e.g., ALEVE®, MOTRIN®, or morphine), anticonvulsant, and antidepressant drugs), and invasive or implantable devices (e.g., electrical stimulation).

The disclosure provides methods of treating (e.g., ameliorating, reducing, or eliminating one or more symptoms of or stabilizing the subject's score on a pain scale) neuropathic pain by administering a plasma kallikrein binding protein (e.g., a therapeutically effective amount of a plasma kallikrein binding protein) to a subject having or suspected of having neuropathic pain. Additionally provided are methods of treating neuropathic pain by administering a plasma kallikrein binding protein (e.g., a therapeutically effective amount of a plasma kallikrein binding protein) in combination with a second therapy, e.g., a nonsurgical treatment ((e.g., a nonsteroidal anti-inflammatory drug (NSAID) (e.g., ALEVE®, MOTRIN®, or morphine), an anticonvulsant, and/or an antidepressant drug), and/or an invasive or implantable device (e.g., electrical stimulation). The disclosure also provides methods of preventing neuropathic pain or a symptom thereof by administering a plasma kallikrein binding protein (e.g., a prophylactically effective amount of a plasma kallikrein binding protein) to a subject at risk of developing neuropathic pain (e.g., a subject that has experienced tissue injury).

Scales useful for the assessment of neuropathic pain include, e.g., Wong-Baker FACES Pain Rating Scale (Wong-Baker FACES Pain Rating Scale Foundation), Visual analog scale (VAS) (Huskisson, J. Rheumatol. 9 (5): 768-9 (1982)), McGill Pain Questionnaire (MPQ) (Melzack, Pain 1 (3): 277-99 (1975)), Descriptor differential scale (DDS) (Gracety and Kwilosz, Pain 35 (3): 279-88 (1988)), Faces Pain Scale—Revised (FPS—R) (Hicks et al., Pain 93 (2): 173-83 (2001)), Numerical 11 point box (BS-11) (Jensen et al., Clin J Pain 5 (2): 153-9 (1989)), Numeric Rating Scale (NRS-11) (Hartrick et al., Pain Pract 3 (4): 310-6 (2003)), Dolorimeter Pain Index (DPI) (Hardy et al., (1952). Pain Sensations and Reactions. Baltimore: The Williams & Wilkins Co.), and Brief Pain Inventory (BPI) (Cleeland and Ryan *Ann. Acad. Med. Singap.* 23 (2): 129-38 (1994)).

Guidance for the determination of the dosage that delivers a therapeutically effective amount of a plasma kallikrein binding protein may be obtained from animal models of neuropathic pain, see, e.g., those described in Martin et al., Methods Mol. Med. 84:233-42 (2003) and references cited therein.

Inflammatory Pain

Inflammatory pain is caused by an insult such as penetration wounds, burns, extreme cold, fractures, arthritis, autoimmune conditions, excessive stretching, infections and vasoconstriction to the integrity of tissues at a cellular level. During inflammation a complex neuro-immune interaction results in primary hyperalgesia, in which a large range of inflammatory molecules including prostaglandins and bradykinin induce and maintain the altered nociceptor sensitivity.

Treatments for inflammatory pain include, e.g., non-steroidal anti-inflammatory drugs (NSAIDs) and corticosteroids.

The disclosure provides methods of treating (e.g., ameliorating, reducing, or eliminating one or more symptoms of) inflammatory pain by administering a plasma kallikrein binding protein (e.g., a therapeutically effective amount of a plasma kallikrein binding protein) to a subject having or suspected of having inflammatory pain. Additionally provided are methods of treating inflammatory pain by administering a plasma kallikrein binding protein (e.g., a therapeutically effective amount of a plasma kallikrein binding protein) in combination with a second therapy, e.g., a non-steroidal anti-inflammatory drug (NSAID) and/or a corticosteroid. The disclosure also provides methods of preventing inflammatory pain or a symptom thereof by administering a plasma kallikrein binding protein (e.g., a prophylactically effective amount of a plasma kallikrein binding protein) to a subject at risk of developing inflammatory pain (e.g., a subject that has experienced an insult, e.g., such as a penetration wound, a burn, extreme cold, a fracture, arthritis, an autoimmune condition, excessive stretching, or infection).

Scales useful for the assessment of inflammatory pain include, e.g., Wong-Baker FACES Pain Rating Scale (Wong-Baker FACES Pain Rating Scale Foundation), Visual analog scale (VAS) (Huskisson, J. Rheumatol. 9 (5): 768-9 (1982)), McGill Pain Questionnaire (MPQ) (Melzack, Pain 1 (3): 277-99 (1975)), Descriptor differential scale (DDS) (Gracety and Kwilosz, Pain 35 (3): 279-88 (1988)), Faces Pain Scale—Revised (FPS—R) (Hicks et al., Pain 93 (2): 173-83 (2001)), Numerical 11 point box (BS-11) (Jensen et al., Clin J Pain 5 (2): 153-9 (1989)), Numeric Rating Scale (NRS-11) (Hartrick et al., Pain Pract 3 (4): 310-6 (2003)), Dolorimeter Pain Index (DPI) (Hardy et al., (1952). Pain Sensations and Reactions. Baltimore: The Williams & Wilkins Co.), and Brief Pain Inventory (BPI) (Cleeland and Ryan *Ann. Acad. Med. Singap.* 23 (2): 129-38 (1994)).

Guidance for the determination of the dosage that delivers a therapeutically effective amount of a plasma kallikrein binding protein may be obtained from animal models of inflammatory pain such as an animal model of chronic inflammatory pain (Wilson et al., Eur J. Pain. 10(6):537-49 (2006)) and an inflammatory model of pain and hyperalgesia (Ren and Dubner, ILAR J. 40(3):111-118 (1999)).

Spinal Stenosis

Spinal stenosis is a medical condition in which the spinal canal narrows and compresses the spinal cord and nerves. This is usually due to the common occurrence of spinal degeneration that occurs with aging. It can also sometimes be caused by spinal disc herniation, osteoporosis or a tumor. Spinal stenosis may affect the cervical, thoracic or lumbar spine. In some cases, it may be present in all three places in the same patient.

Symptoms of spinal stenosis include, e.g., pain or cramping in the legs, radiating back and hip pain, pain in the neck and shoulders, loss of balance, and loss of bowel or bladder function (cauda equina syndrome).

Treatments for spinal stenosis include, e.g., nonsurgical treatments (e.g., physical therapy, non-steroidal anti-inflammatory drugs (NSAIDs) (e.g., aspirin, ibuprofen and indomethacin), analgesics (e.g., acetaminophen), chondroitin sulfate, glucosamine, rest or restricted activity, back brace or corset, epidural steroid injections (e.g., corticosteroid)), and surgery (e.g., decompressive laminectomy, laminotomy and fusion).

The disclosure provides methods of treating (e.g., ameliorating, reducing, or eliminating one or more symptoms of) spinal stenosis by administering a plasma kallikrein binding protein (e.g., a therapeutically effective amount of a plasma kallikrein binding protein) to a subject having or suspected of having spinal stenosis. Additionally provided are methods of treating spinal stenosis by administering a plasma kallikrein binding protein (e.g., a therapeutically effective amount of a plasma kallikrein binding protein) in combination with a second therapy, e.g., a nonsurgical treatment (e.g., physical therapy and/or a nonsteroidal anti-inflammatory drug (NSAID) (e.g., aspirin, ibuprofen or indomethacin), an analgesic (e.g., acetaminophen), chondroitin sulfate, glucosamine, rest or restricted activity, a back brace or corset, an epidural steroid injection (e.g., corticosteroid), and/or surgery (e.g., decompressive laminectomy, laminotomy and/or fusion). The disclosure also provides methods of preventing spinal stenosis or a symptom thereof by administering a plasma kallikrein binding protein (e.g., a prophylactically effective amount of a plasma kallikrein binding protein) to a subject at risk of developing spinal stenosis (e.g., a subject that has spinal degeneration).

Guidance for the determination of the dosage that delivers a therapeutically effective amount of a plasma kallikrein binding protein may be obtained from animal models of spinal stenosis, such as a model of lumbar spinal stenosis (Sekiguchi et al., Spine 29, 1105-1111 (2004)).

Arterial and Venous Thrombosis

Arterial thrombosis is the formation of a thrombus within an artery. In most cases, arterial thrombosis follows rupture of atheroma, and is therefore referred to as atherothrombosis.

Arterial thrombosis is associated with a number of disorders, including stroke and myocardial infarction. In thrombotic stroke, a thrombus (blood clot) usually forms around atherosclerotic plaques. Since blockage of the artery is gradual, onset of symptomatic thrombotic strokes is slower. Thrombotic stroke can be divided into two categories—large vessel disease and small vessel disease. The former affects vessels such as the internal carotids, vertebral and the circle of Willis. The latter can affect smaller vessels such as the branches of the circle of Willis. Myocardial infarction (MI) is caused by an infarct (death of tissue due to ischemia), often due to the obstruction of the coronary artery by a thrombus. MI can quickly become fatal if emergency medical treatment is not received promptly.

Venous thrombosis is a blood clot that forms within a vein. If a piece of a blood clot formed in a vein breaks off, it can be transported to the right side of the heart, and from there into the lungs. A piece of thrombus that is transported in this way is an embolism and the process of forming a thrombus that becomes embolic is called a thromboembolism. An embolism that lodges in the lungs is a pulmonary embolism (PE). A pulmonary embolus is a very serious condition that can be fatal if not recognized and treated promptly.

Superficial venous thromboses can cause discomfort but generally do not cause serious consequences, unlike the deep venous thromboses (DVTs) that form in the deep veins of the legs or in the pelvic veins. Systemic embolisms of venous origin can occur in patients with an atrial or ventricular septal defect, through which an embolus may pass into the arterial system. Such an event is termed a paradoxical embolism.

Prevention of arterial and/or venous thrombosis includes medications (e.g., anticoagulants (e.g., heparin), aspirin, and vitamin E) and mechanical methods (e.g., mechanical leg pumps (pneumatic compression stockings)).

The disclosure provides methods of treating (e.g., ameliorating, reducing, or eliminating one or more symptoms of) arterial and/or venous thrombosis by administering a plasma kallikrein binding protein (e.g., a therapeutically effective amount of a plasma kallikrein binding protein) to a subject having or suspected of having arterial and/or venous thrombosis. Additionally provided are methods of treating arterial and/or venous thrombosis by administering a plasma kallikrein binding protein (e.g., a therapeutically effective amount of a plasma kallikrein binding protein) in combination with a second therapy, e.g., an anticoagulant (e.g., heparin), aspirin, and/or vitamin E and/or a mechanical method (e.g., a mechanical leg pump (pneumatic compression stockings). The disclosure also provides methods of preventing arterial and/or venous thrombosis or a symptom thereof by administering a plasma kallikrein binding protein (e.g., a prophylactically effective amount of a plasma kallikrein binding protein) to a subject at risk of developing arterial and/or venous thrombosis (e.g., a subject that has experienced a stroke or myocardial infarction).

Guidance for the determination of the dosage that delivers a therapeutically effective amount of a plasma kallikrein binding protein may be obtained from animal models of arterial or venous thrombosis, such as a double-tuck model of arterial thrombosis (Gomez-Jorge et al., J. Vasc. Inter. Rad. 9(4): 633-638 (1998), a model of venous thrombosis in rat with low flow conditions in the venous blood stream (Fredrich et al., Blood Coagul Fibrinolysis. 5(2):243-8 (1994)), and a canine model for venous thrombosis and spontaneous pulmonary embolism (Frisbiel, Spinal Cord 43, 635-639 (2005)).

Postoperative Ileus

Postoperative ileus is a temporary paralysis of a portion of the intestines typically after an abdominal surgery. Postoperative ileus commonly occurs for 24 to 72 hours after abdominal surgery.

Symptoms of postoperative ileus include, e.g., moderate and diffuse abdominal discomfort, constipation, abdominal distension, nausea or vomiting, lack of bowel movement and/or flatulence, and excessive belching.

Treatments for postoperative ileus include, e.g., nil per os (NPO or "Nothing by Mouth") until peristaltic sound is heard from auscultation of the area where this portion lies, nasogastric suction, parenteral feeds, and medications (e.g., lactulose and erythromycin).

The disclosure provides methods of treating (e.g., ameliorating, reducing, or eliminating one or more symptoms of) postoperative ileus by administering a plasma kallikrein binding protein (e.g., a therapeutically effective amount of a plasma kallikrein binding protein) to a subject having or suspected of having postoperative ileus. Additionally provided are methods of treating postoperative ileus by administering a plasma kallikrein binding protein (e.g., a therapeutically effective amount of a plasma kallikrein binding protein) in combination with a second therapy, e.g., nil per os, nasogastric suction, parenteral feeds, and/or a medication (e.g., lactulose and/or erythromycin). The disclosure also provides methods of preventing postoperative ileus or a symptom thereof by administering a plasma kallikrein binding protein (e.g., a prophylactically effective amount of a plasma kallikrein binding protein) to a subject at risk of developing postoperative ileus (e.g., a subject that has had abdominal surgery).

Guidance for the determination of the dosage that delivers a therapeutically effective amount of a plasma kallikrein binding protein may be obtained from animal models of postoperative ileus, such as a model to investigate postoperative ileus with strain gauge transducers in awake rats (Huge et al. J Surg Res. 74(2):112-8 (1998)).

Aortic Aneurysm

An aortic aneurysm is a general term for any swelling (dilatation or aneurysm) of the aorta, usually representing an underlying weakness in the wall of the aorta at that location. Types of aortic aneurysms include aortic root aneurysm, thoracic aortic aneurysm, abdominal aortic aneurysm, and thoracoabdominal aortic aneurysm.

Most intact aortic aneurysms do not produce symptoms. As they enlarge, symptoms of aortic aneurysm include, e.g., anxiety or feeling of stress, nausea or vomiting, clammy skin, rapid heart rate, abdominal pain, back pain may develop, leg pain or numbness, erythema nodosum (leg lesions typically found near the ankle region), and a hoarse voice as the left recurrent laryngeal nerve winding around the arch of the aorta is stretched. Once an aneurysm is ruptured, it can cause severe pain and massive internal hemorrhage, and is fatal in the absence of prompt treatment.

Treatments for aortic aneurysm include, e.g., medications, surgical treatment and endovascular treatment. Smaller aneurysms that are not at high risk for rupturing can be treated with drugs to treat high blood pressure, such as beta-blockers; or doxycycline for matrix metalloproteinase-9 inhibition. Surgical treatment typically involves opening up of the dilated portion of the aorta and insertion of a synthetic (Dacron or Gore-tex) patch tube. Endovascular treatment, as a minimally invasive alternative to open surgery repair, involves the placement of an endovascular stent via a percutaneous technique (usually through the femoral arteries) into the diseased portion of the aorta.

The disclosure provides methods of treating (e.g., stabilizing, reducing, or eliminating one or more symptoms of) aortic aneurysm by administering a plasma kallikrein binding protein (e.g., a therapeutically effective amount of a plasma kallikrein binding protein) to a subject having or suspected of having aortic aneurysm. Additionally provided are methods of treating aortic aneurysm by administering a plasma kallikrein binding protein (e.g., a therapeutically effective amount of a plasma kallikrein binding protein) in combination with a second therapy, e.g., a medication (e.g., a drug to treat high blood pressure (e.g., a beta-blocker) or doxycycline), surgery, and/or an endovascular treatment. The disclosure also provides methods of preventing aortic aneurysm or a symptom thereof by administering a plasma kallikrein binding protein (e.g., a prophylactically effective amount of a plasma kallikrein binding protein) to a subject at risk of developing aortic aneurysm (e.g., a subject that has high blood pressure).

Guidance for the determination of the dosage that delivers a therapeutically effective amount of a plasma kallikrein binding protein may be obtained from an animal model of aortic aneurysm, e.g., a rat model of abdominal aortic aneurysm using a combination of intraluminal elastase infusion and extraluminal calcium chloride exposure (Tanaka et al. J Vasc Surg. 50(6):1423-32 (2009)).

Osteoarthritis

Osteoarthritis, also known as degenerative arthritis, is characterized by the breakdown and eventual loss of the cartilage of one or more joints. Osteoarthritis occurs when the cartilage that cushions the ends of bones in the joints deteriorates over time. The smooth surface of the cartilage becomes rough, causing irritation. If the cartilage wears down completely, the ends of the bones will be damaged. Osteoarthritis commonly affects the hands, feet, spine, and large weight-bearing joints, such as the hips and knees.

Symptoms of osteoarthritis include, e.g., pain, tenderness, stiffness, loss of flexibility, grating sensation, and bone spurs.

Treatments for osteoarthritis include, e.g., conservative measures (e.g., rest, weight reduction, physical and occupational therapy) and medications (e.g., acetaminophen, pain-relieving creams applied to the skin over the joints (e.g., capsaicin, salycin, methyl salicylate, and menthol), non-steroidal anti-inflammatory drugs (NSAIDs) (e.g., aspirin, ibuprofen, nabumetone and naproxen), and Cox-2 inhibitors.

The disclosure provides methods of treating (e.g., stabilizing, reducing, or eliminating one or more symptoms or stabilizing the subject's score on an osteoarthritis scale) osteoarthritis by administering a plasma kallikrein binding protein (e.g., a therapeutically effective amount of a plasma kallikrein binding protein) to a subject having or suspected of having osteoarthritis. Additionally provided are methods of treating osteoarthritis by administering a plasma kallikrein binding protein (e.g., a therapeutically effective amount of a plasma kallikrein binding protein) in combination with a second therapy, e.g., a conservative measure (e.g., rest, weight reduction, physical and/or occupational therapy) and/or a medication (e.g., acetaminophen, a topical pain-relieving cream, an NSAID (e.g., aspirin, ibuprofen, nabumetone, or naproxen), and/or a Cox-2 inhibitor. The disclosure also provides methods of preventing osteoarthritis or a symptom thereof by administering a plasma kallikrein binding protein (e.g., a prophylactically effective amount of a plasma kallikrein binding protein) to a subject at risk of developing osteoarthritis (e.g., a subject that has had a joint injury).

Scales useful for the assessment of osteoarthritis include, e.g., the Knee Injury and Osteoarthritis Outcome Score (KOOS; Roos et al. (1998) J. Orthop. Sports Phys. Ther. 28(2):88-96), Western Ontario and McMaster Universities Osteoarthrtis Index (WOMAC; Roos et al. (2003) *Health Qual. Life Outcomes* 1(1):17), and the 36-item Short Form General Health Scale (SF-36 GHS), as well as other assessment tools known in the art.

Guidance for the determination of the dosage that delivers a therapeutically effective amount of a plasma kallikrein binding protein may be obtained from an animal model of osteoarthritis, e.g., injection of mono-iodoacetate (MIA) into the femorotibial joint of rodents which promotes loss of articular cartilage similar to that noted in human osteoarthritis (Guzman et al. Toxicol Pathol. 31(6):619-24 (2003)), and transection of the anterior cruciate ligament (ACL) in canines to induce osteoarthritis (Fife and Brandt J Clin Invest. 84(5): 1432-1439 (1989)).

Vasculitis

Vasculitis refers to a heterogeneous group of disorders that are characterized by inflammatory destruction of blood vessels. Both arteries and veins can be affected. Lymphangitis is sometimes considered a type of vasculitis. Vasculitis is primarily due to leukocyte migration and resultant damage. Vasculitis can be classified by the underlying cause, the location of the affected vessels, or the type or size of the blood vessels. Vasculitis is associated with a number of additional disorders and conditions, e.g., Kawasaki disease, Behçet's disease, Polyarteritis nodosa, Wegener's granulomatosis, Cryoglobulinemia, Takayasu's arteritis, Churg-Strauss syndrome, Giant cell arteritis (temporal arteritis), Henoch-Schonlein purpura, Rheumatic diseases (e.g., rheumatoid arthritis and systemic lupus erythematosus), cancer (e.g., lymphomas), infections (e.g., hepatitis C), exposure to chemicals and drugs (e.g., amphetamines, cocaine, and anthrax vaccines which contain the Anthrax Protective Antigen as the primary ingredient).

Symptoms of vasculitis include, e.g., fever, weight loss, palpable purpura, livedo reticularis, myalgia or myositis, arthralgia or arthritis, mononeuritis multiplex, headache, stroke, tinnitus, reduced visual acuity, acute visual loss, myocardial infarction, hypertension, gangrene, nose bleeds, bloody cough, lung infiltrates, abdominal pain, bloody stool, perforations, and glomerulonephritis.

Treatments for vasculitis include, e.g., cortisone-related medications (e.g., prednisone) and immune suppression drugs (e.g., cyclophosphamide).

The disclosure provides methods of treating (e.g., stabilizing, reducing, or eliminating one or more symptoms or stabilizing the subject's score on a vasculitis scale) vasculitis by administering a plasma kallikrein binding protein (e.g., a therapeutically effective amount of a plasma kallikrein binding protein) to a subject having or suspected of having vasculitis. Additionally provided are methods of treating vasculitis by administering a plasma kallikrein binding protein (e.g., a therapeutically effective amount of a plasma kallikrein binding protein) in combination with a second therapy (e.g., a cortisone-related medication (e.g., prednisone) and/or an immune suppression drug (e.g., cyclophosphamide)). The disclosure also provides methods of preventing vasculitis or a symptom thereof by administering a plasma kallikrein binding protein (e.g., a prophylactically effective amount of a plasma kallikrein binding protein) to a subject at risk of developing vasculitis (e.g., a subject that has had Kawasaki disease, Behçet's disease, Polyarteritis nodosa, Wegener's granulomatosis, Cryoglobulinemia, or Takayasu's arteritis, and so forth).

The disclosure also provides methods of treating (e.g., stabilizing, reducing, or eliminating one or more symptoms or stabilizing the subject's score on a vasculitis scale) vasculitis associated with systemic lupus erythematosis by administering a plasma kallikrein binding protein (e.g., a therapeutically effective amount of a plasma kallikrein binding protein) to a subject having or suspected of having vasculitis associated with systemic lupus erythematosis. Additionally provided are methods of treating vasculitis associated with systemic lupus erythematosis by administering a plasma kallikrein binding protein (e.g., a therapeutically effective amount of a plasma kallikrein binding protein) in combination with a second therapy, e.g., a cortisone-related medication (e.g., prednisone) and/or an immune suppression drug (e.g., cyclophosphamide).

Further provided are methods of treating (e.g., ameliorating, stabilizing, or eliminating one or more symptoms) a vasculitis associated disorder (Kawasaki disease, Behçet's disease, Polyarteritis nodosa, Wegener's granulomatosis, Cryoglobulinemia, Takayasu's arteritis, Churg-Strauss syndrome, Giant cell arteritis (temporal arteritis), Henoch-Schonlein purpura, Rheumatic diseases (e.g., rheumatoid arthritis and systemic lupus erythematosus), cancer (e.g., lymphomas), infections (e.g., hepatitis C), exposure to chemicals and drugs (e.g., amphetamines, cocaine, and anthrax vaccines which contain the Anthrax Protective Antigen as the primary ingredient)) by administering a plasma kallikrein binding protein (e.g., a therapeutically effective amount of a plasma kallikrein binding protein) to a subject having or suspected of having a vasculitis associated disorder. The disclosure also provides methods of preventing a vasculitis associated disorder or a symptom thereof by administering a plasma kallikrein binding protein (e.g., a prophylactically effective amount of a plasma kallikrein binding protein) to a subject at risk of developing a vasculitis associated disorder.

Scales useful for the assessment of osteoarthritis include, e.g., Birmingham Vasculitis Activity score (BVAS) version 3 (Mukhtyar et al. Ann Rheum Dis. 68(12):1827-32 (2009)), as well as other assessment tools known in the art.

Guidance for the determination of the dosage that delivers a therapeutically effective amount of a plasma kallikrein binding protein may be obtained from an animal model of vasculitis, see e.g., those described in Katz et al., Clin Rev Allergy Immunol. 35(1-2):11-8 (2008) and references cited therein.

Head Trauma

Head trauma refers to trauma to the head, which may or may not include injury to the brain. Types of head trauma include concussion, epidural hematoma, subdural hematoma, cerebral contusion, and diffuse axonal injury.

Symptoms of head trauma include, e.g., coma, confusion, drowsiness, personality change, seizures, nausea and vomiting, headache and a lucid interval, during which a patient appears conscious only to deteriorate later, leaking cerebrospinal fluid, visible deformity or depression in the head or face, an eye that cannot move or is deviated to one side can indicate that a broken facial bone is pinching a nerve that innervates eye muscles, wounds or bruises on the scalp or face, basilar skull fractures, a subcutaneous bleed over the mastoid, hemotympanum, cerebrospinal fluid rhinorrhea, and otorrhea.

Treatments for head trauma include, e.g., controlling elevated intracranial pressure (e.g., sedation, paralytics, cerebrospinal fluid diversion), decompressive craniectomy, barbiturate coma, hypertonic saline, and hypothermia.

The disclosure provides methods of treating (e.g., stabilizing, reducing, or eliminating one or more symptoms or stabilizing the subject's score on a head trauma scale) head trauma by administering a plasma kallikrein binding protein (e.g., a therapeutically effective amount of a plasma kallikrein binding protein) to a subject having or suspected of having head trauma. Additionally provided are methods of treating head trauma by administering a plasma kallikrein binding protein (e.g., a therapeutically effective amount of a plasma kallikrein binding protein) in combination with a second therapy, e.g., controlling elevated intracranial pressure (e.g., sedation, a paralytic, and/or cerebrospinal fluid diversion), decompressive craniectomy, barbiturate coma, hypertonic saline, and/or hypothermia. The disclosure also provides methods of preventing head trauma or a symptom thereof by administering a plasma kallikrein binding protein (e.g., a prophylactically effective amount of a plasma kallikrein binding protein) to a subject at risk of developing head trauma (e.g., a subject that will be participating in a dangerous activity or contact sport).

Scales useful for assessing head trauma and symptoms of head trauma include, e.g., the Glasgow Coma Scale (Teasdale and Jennett, Lancet 13; 2(7872):81-4 (1974)), as well as other assessment tools known in the art.

Guidance for the determination of the dosage that delivers a therapeutically effective amount of a plasma kallikrein binding protein may be obtained from animal models of head trauma, see, e.g., those described in Cernak, NeuroRx. 2(3): 410-422 (2005) and references cited therein.

Brain Edema

Brain edema (cerebral edema) is an excess accumulation of water in the intracellular and/or extracellular spaces of the brain. Types of brain edema include, e.g., vasogenic cerebral edema, cytotoxic cerebral edema, osmotic cerebral edema, and interstitial cerebral edema.

Vasogenic cerebral edema is due to a breakdown of tight endothelial junctions which make up the blood-brain barrier (BBB). This allows normally excluded intravascular proteins and fluid to penetrate into cerebral parenchymal extracellular space. Once plasma constituents cross the BBB, the edema spreads; this may be quite fast and widespread. As water enters white matter it moves extracellularly along fiber tracts and can also affect the gray matter. This type of edema is seen in response to trauma, tumors, focal inflammation, late stages of cerebral ischemia and hypertensive encephalopathy. Some of the mechanisms contributing to BBB dysfunction are: physical disruption by arterial hypertension or trauma, tumor-facilitated release of vasoactive and endothelial destructive compounds (e.g., arachidonic acid, excitatory neurotransmitters, eicosanoids, bradykinin, histamine and free radicals). Some of the special subcategories of vasogenic edema include: hydrostatic cerebral edema, cerebral edema from brain cancer, high altitude cerebral edema.

Cytotoxic cerebral edema is due to the derangement in cellular metabolism resulting in inadequate functioning of the sodium and potassium pump in the glial cell membrane. As a result there is cellular retention of sodium and water. Cytotoxic edema is seen with various intoxications (dinitrophenol, triethyltin, hexachlorophene, isoniazid), in Reye's syndrome, severe hypothermia, early ischemia, encephalopathy, early stroke or hypoxia, cardiac arrest, pseudotumor cerebri, and cerebral toxins.

Osmotic cerebral edema occurs when plasma is diluted by excessive water intake (or hyponatremia), syndrome of inappropriate antidiuretic hormone secretion (SIADH), hemodialysis, or rapid reduction of blood glucose in hyperosmolar hyperglycemic state (HHS), formerly hyperosmolar non-ketotic acidosis (HONK) and brain osmolality exceeds the serum osmolality creating an abnormal pressure.

Interstitial cerebral edema occurs in obstructive hydrocephalus. This form of edema is due to rupture of cerebral-spinal fluid (CSF)-brain barrier resulting in trans-ependymal flow of CSF, which permits CSF to penetrate brain and spread in the extracellular space of white matter.

Symptoms of brain edema (e.g., peritumoral brain edema) include, e.g., headache, loss of coordination (ataxia), weakness, and decreasing levels of consciousness including disorientation, loss of memory, hallucinations, psychotic behavior, and coma.

Treatments for brain edema (e.g., peritumoral brain edema) include, e.g., medications (e.g. dexamethasone, mannitol, diuretics) and surgical decompression.

The disclosure provides methods of treating (e.g., stabilizing, reducing, or eliminating one or more symptoms of) brain edema (e.g., peritumoral brain edema) by administering a plasma kallikrein binding protein (e.g., a therapeutically effective amount of a plasma kallikrein binding protein) to a subject having or suspected of having brain edema (e.g., peritumoral brain edema). Additionally provided are methods of treating brain edema (e.g., peritumoral brain edema) by administering a plasma kallikrein binding protein (e.g., a therapeutically effective amount of a plasma kallikrein binding protein) in combination with a second therapy, e.g., a medication (e.g. dexamethasone, mannitol, and/or diuretics) and/or surgical decompression. The disclosure also provides methods of preventing brain edema or a symptom thereof by administering a plasma kallikrein binding protein (e.g., a prophylactically effective amount of a plasma kallikrein binding protein) to a subject at risk of developing brain edema (e.g., a subject that has been diagnosed with a brain tumor).

Guidance for the determination of the dosage that delivers a therapeutically effective amount of a plasma kallikrein binding protein may be obtained from animal models of brain edema, e.g., a rat model of cerebral embolism in which recirculation can be introduced in the ischemic area (Koizumi et al., Jpn J Stroke 8: 1-8 (1986)).

Sepsis

Sepsis is a serious medical condition that is characterized by a whole-body inflammatory state and the presence of a known or suspected infection. This immunological response may be caused by microbes in the blood, urine, lungs, skin, or other tissues and can lead to widespread activation of acute-phase proteins, affecting the complement system and the coagulation pathways, which then cause damage to the vasculature as well as to the organs. Different levels of sepsis include systemic inflammatory response syndrome (SIRS), sepsis (SIRS in response to a confirmed infectious process), severe sepsis (sepsis with organ dysfunction, hypoperfusion, or hypotension), and septic shock (sepsis with refractory arterial hypotension or hypoperfusion abnormalities in spite of adequate fluid resuscitation).

Symptoms of sepsis include, e.g., general symptoms related to the infection, acute inflammation present throughout the entire body, hypothermia or fever, tachycardia, tachypnea or hypocapnia due to hyperventilation, leukopenia, leukocytosis, bandemia, and organ (e.g., lung, brain, liver, kidney, and/or heart) dysfunction.

Treatments for sepsis include, e.g., antibiotics, vasopressor drugs, insulin, corticosteroids, drotrecogin alfa, surgical drainage of infected fluid collections, fluid replacement, and appropriate support for organ dysfunction (e.g., hemodialysis in kidney failure, mechanical ventilation in pulmonary dysfunction, transfusion of blood products, and drug and fluid therapy for circulatory failure). Early Goal Directed Therapy (EGDT), a systematic approach to resuscitation, can be used to treat severe sepsis and septic shock.

The disclosure provides methods of treating (e.g., stabilizing, reducing, or eliminating one or more symptoms or stabilizing the subject's score on a sepsis scale) sepsis by administering a plasma kallikrein binding protein (e.g., a therapeutically effective amount of a plasma kallikrein binding protein) to a subject having or suspected of having sepsis. Additionally provided are methods of treating sepsis by administering a plasma kallikrein binding protein (e.g., a therapeutically effective amount of a plasma kallikrein binding protein) in combination with a second therapy, e.g., an antibiotic, a vasopressor drug, insulin, a corticosteroid, drotrecogin alfa, surgical drainage of infected fluid collections, fluid replacement, an appropriate support for organ dysfunction (e.g., hemodialysis in kidney failure, mechanical ventilation in pulmonary dysfunction, transfusion of blood products, and/or drug and fluid therapy for circulatory failure), and/or an Early Goal Directed Therapy (EGDT). The disclosure also provides methods of preventing sepsis or a symptom thereof by administering a plasma kallikrein binding protein (e.g., a prophylactically effective amount of a plasma kallikrein binding protein) to a subject at risk of developing sepsis (e.g., a subject that has been diagnosed as having an infection).

Scales useful for assessing sepsis and symptoms of sepsis include, e.g., the Baltimore Sepsis Scale (Meek et al. *J Burn Care Rehabil.* 12(6):564-8 (1991)) as well as other assessment tools known in the art.

Guidance for the determination of the dosage that delivers a therapeutically effective amount of a plasma kallikrein binding protein may be obtained from animal models of sepsis, see, e.g., those described in U.S. Pat. No. 6,964,856, and Buras et al. Nat Rev Drug Discov. 4(10):854-65 (2005) and references cited therein.

Acute Middle Cerebral Artery (MCA) Ischemic Event (Stroke)

An acute middle cerebral artery (MCA) ischemic event (stroke) is the rapidly developing loss of brain function(s) due to disturbance in the blood supply to the brain due to ischemia (lack of glucose and oxygen supply) caused by thrombosis (e.g., venous thrombosis), embolism, or systemic hypoperfusion. As a result, the affected area of the brain is unable to function, leading to inability to move one or more limbs on one side of the body, inability to understand or formulate speech, or inability to see one side of the visual field. A stroke is a medical emergency and can cause permanent neurological damage, complications, and/or death.

Symptoms of acute middle cerebral artery (MCA) ischemic event (stroke) include, e.g., hemiplegia, decreased sensation and muscle weakness of the face, numbness, reduction in sensory or vibratory sensation, altered smell, taste, hearing or vision (total or partial), drooping of eyelid (ptosis) and weakness of ocular muscles, decreased reflexes, balance problems and nystagmus, altered breathing and heart rate, weakness in sternocleidomastoid muscle with inability to turn head to one side, weakness in tongue (inability to protrude and/or move from side to side), aphasia, apraxia, visual field defect, memory deficits, hemineglect, disorganized thinking, confusion, hypersexual gestures, anosognosia, trouble walking, altered movement coordination, and vertigo and/or disequilibrium Treatment for acute middle cerebral artery (MCA) ischemic event (stroke) includes, e.g., thrombolysis (e.g., tissue plasminogen activator (tPA)), thrombectomy, angioplasty and stenting, therapeutic hypothermia, and medications (e.g., aspirin, clopidogrel and dipyridamole).

The disclosure provides methods of treating (e.g., stabilizing, reducing, or eliminating one or more symptoms or stabilizing the subject's score on a stroke scale) acute middle cerebral artery (MCA) ischemic event (stroke) by administering a plasma kallikrein binding protein (e.g., a therapeutically effective amount of a plasma kallikrein binding protein) to a subject having or suspected of having acute middle cerebral artery (MCA) ischemic event (stroke). Additionally provided are methods of treating acute middle cerebral artery (MCA) ischemic event (stroke) by administering a plasma kallikrein binding protein (e.g., a therapeutically effective amount of a plasma kallikrein binding protein) in combination with a second therapy, e.g., thrombolysis (e.g., tissue plasminogen activator (tPA)), thrombectomy, angioplasty and stenting, therapeutic hypothermia, and/or a medication (e.g., aspirin, clopidogrel and dipyridamole). The disclosure also provides methods of preventing acute middle cerebral artery (MCA) ischemic event (stroke) or a symptom thereof by administering a plasma kallikrein binding protein (e.g., a prophylactically effective amount of a plasma kallikrein binding protein) to a subject at risk of developing acute middle cerebral artery (MCA) ischemic event (stroke) (e.g., a subject that has experienced systemic hypoperfusion).

Scales useful for assessing acute middle cerebral artery (MCA) ischemic event (stroke) and symptoms of acute middle cerebral artery (MCA) ischemic event (stroke) include, e.g., Oxford Community Stroke Project classification (OCSP, also known as the Bamford or Oxford classification) (Bamford et al., Lancet 337 (8756): 1521-6 (1991)), and TOAST (Trial of Org 10172 in Acute Stroke Treatment) (Adams et al., *Stroke* 24 (1): 35-41 (1993)).

Guidance for the determination of the dosage that delivers a therapeutically effective amount of a plasma kallikrein binding protein may be obtained from animal models of acute middle cerebral artery (MCA) ischemic event (stroke), see, e.g., those described in Beech et al., Brain Res 895: 18-24 (2001), Buchan et al., Stroke 23 (2): 273-9 (1992), Carmichael, NeuroRx 2: 396-409 (2005), Chen et al., Stroke 17 (4): 738-43 (1986), Dittmar et al., Stroke 34: 2252-7 (2003), Dittmar et al., J Neurosci Methods 156: 50 (2006), Gerriets et al., J Neurosci Methods 122: 201-11 (2003), Gerriets et al., Stroke 35: 2372-2377 (2004), Graham et al., Comp Med 54: 486-496 (2004), Koizumi et al., Jpn J Stroke 8: 1-8 (2004), Longa et al., Stroke 20 (1): 84-91 (1989), Mayzel-Oreg, Magn Reson Med 51: 1232-8 (2004), Schmid-Elsaesser et al., Stroke 29 (10): 2162-70 (1989), Tamura et al., J Cereb Blood Flow Metab 1: 53-60 (1981), Watson et al., Ann Neurol 17: 497-504 (1985), and Zhang et al., J Cereb Blood Flow Metab 17: 123-35 (1997).

Restenosis

Restenosis is the reoccurrence of stenosis, a narrowing of a blood vessel, leading to restricted blood flow. Restenosis usually pertains to an artery or other large blood vessel that has become narrowed, received treatment to clear the blockage such as angioplasty, and subsequently become renarrowed. It can be defined as a reduction in the circumference of the lumen of 50% or more, and had a high incidence rate (25-50%) in patients who had undergone balloon angioplasty, with the majority of patients needing further angioplasty within 6 months.

Treatments for restenosis include, e.g., additional angioplasty if restenosis occurs without a stent or at either end of a stent, repeated angioplasty and insertion of another stent inside the original if restenosis occurs within a stent, drug-eluted stents, brachytherapy, and intracoronary radiation.

The disclosure provides methods of treating (e.g., stabilizing, reducing, or eliminating one or more symptoms of) restenosis (e.g., after angioplasty) by administering a plasma kallikrein binding protein (e.g., a therapeutically effective amount of a plasma kallikrein binding protein) to a subject having or suspected of having restenosis (e.g., after angioplasty). Additionally provided are methods of treating restenosis (e.g., after angioplasty) by administering a plasma kallikrein binding protein (e.g., a therapeutically effective amount of a plasma kallikrein binding protein) in combination with a second therapy, e.g., angioplasty if restenosis occurs without a stent or at either end of a stent, repeated angioplasty and insertion of another stent inside the original if restenosis occurs within a stent, a drug-eluted stent, brachytherapy, and/or intracoronary radiation. The disclosure also provides methods of preventing restenosis or a symptom thereof by administering a plasma kallikrein binding protein (e.g., a prophylactically effective amount of a plasma kallikrein binding protein) to a subject at risk of developing restenosis (e.g., a subject that has had stenosis).

Guidance for the determination of the dosage that delivers a therapeutically effective amount of a plasma kallikrein binding protein may be obtained from animal models of restenosis, see, e.g., those described in U.S. Pat. Nos. 5,304,122 and 6,034,053, and Kantor et al., Cardiovasc Radiat Med. 1(1):48-54 (1999), and references cited therein.

Systemic Lupus Erythematosus Nephritis

Systemic lupus erythematosus nephritis is an inflammation of the kidney caused by systemic lupus erythematosus (SLE), a chronic autoimmune connective tissue disease. SLE can be associated with vasculitis which are disorders characterized by inflammatory destruction of blood vessels.

Symptoms of systemic lupus erythematosus nephritis include, e.g., general symptoms of kidney disease, weight gain, high blood pressure, darker foamy urine, and swelling around the eyes, legs, ankles or fingers.

Treatments for systemic lupus erythematosus nephritis include, e.g., steroid therapy (e.g., corticosteroids), chemotherapy (e.g., cyclophosphamide, azathioprine, mycophenolate mofetil, or cyclosporine), and immunosuppressant agents (e.g., mycophenolate mofetil and intravenous cyclophosphamide).

The disclosure provides methods of treating (e.g., stabilizing, reducing, or eliminating one or more symptoms or stabilizing the subject's score on a lupus scale) systemic lupus erythematosus nephritis by administering a plasma kallikrein binding protein (e.g., a therapeutically effective amount of a plasma kallikrein binding protein) to a subject having or suspected of having systemic lupus erythematosus nephritis. Additionally provided are methods of treating systemic lupus erythematosus nephritis by administering a plasma kallikrein binding protein (e.g., a therapeutically effective amount of a plasma kallikrein binding protein) in combination with a second therapy, e.g., steroid therapy (e.g., a corticosteroid), chemotherapy (e.g., cyclophosphamide, azathioprine, mycophenolate mofetil, and/or cyclosporine), and/or an immunosuppressant agent (e.g., mycophenolate mofetil and/or intravenous cyclophosphamide). The disclosure also provides methods of preventing systemic lupus erythematosus nephritis or a symptom thereof by administering a plasma kallikrein binding protein (e.g., a prophylactically effective amount of a plasma kallikrein binding protein) to a subject at risk of developing systemic lupus erythematosus nephritis (e.g., a subject that has been diagnosed with lupus or a subject having a family member with lupus or a genetic predisposition thereto).

Scales useful for assessing systemic lupus erythematosus nephritis and symptoms of systemic lupus erythematosus nephritis include, e.g., World Health Organization (WHO) classification based on the biopsy (Weening et al., *J. Am. Soc. Nephrol.* 15 (2): 241-50 (2004)) as well as other assessment tools known in the art.

Guidance for the determination of the dosage that delivers a therapeutically effective amount of a plasma kallikrein binding protein may be obtained from animal models of systemic lupus erythematosus nephritis, see, e.g., those described in U.S. Pat. No. 7,265,261, Peng, Methods Mol. Med. 102:227-72 (2004), and references cited therein.

Burn Injury and Wound Healing

A burn injury is a type of injury that may be caused by heat, electricity, chemicals, light, radiation, or friction. Muscle, bone, blood vessel, dermal and epidermal tissue can all be damaged with subsequent pain due to profound injury to nerves. Depending on the location affected and the degree of severity, a burn victim may experience a wide number of potentially fatal complications including shock, infection, electrolyte imbalance and respiratory distress. In burn injuries, the damage to epidermis and dermal elements is the result of several key insults which can be divided into initial (e.g., heat injury, inflammatory mediator injury, ischemia induced injury) and delayed insults. Excess heat causes rapid protein denaturation and cell damage. Much of the tissue damage, e.g., in the perfused subsurface burn, can be caused by toxic mediators of inflammation (e.g., oxidants and/or proteases) which are activated with the burn. Consumption of wound oxygen by neutrophils can lead to tissue hypoxia. Instant surface vascular thrombosis occurs along with cell death from the heat insult and causes ischemia and further tissue damage. Delayed injury after the initial heat and mediator damage includes, e.g., inflammation caused by neurotic tissue, bacteria on surface, caustic topical agents, and surface exudate; and continued damage to viable cells and new tissue growth by excess wound proteolytic activity and oxidant release.

Treatments of burn injury include, e.g., intravenous fluids, dressings, pain management (e.g., analgesics (e.g., ibuprofen and acetaminophen), narcotics, and local anesthetics), inflammatory mediator inhibitors, and antibiotics.

The disclosure provides methods of treating (e.g., stabilizing, reducing, or eliminating one or more symptoms or stabilizing the subject's score on a burn scale) a burn injury and/or promoting wound healing by administering a plasma kallikrein binding protein (e.g., a therapeutically effective amount of a plasma kallikrein binding protein) to a subject having or suspected of having a burn injury. Additionally provided are methods of treating a burn injury by administering a plasma kallikrein binding protein (e.g., a therapeutically effective amount of a plasma kallikrein binding protein) in combination with a second therapy, e.g., intravenous fluid, a dressing, pain management (e.g., an analgesic (e.g., ibuprofen and acetaminophen), a narcotic, and a local anesthetic), an inflammatory mediator inhibitor, and an antibiotic. The disclosure also provides methods of preventing burn injuries or a symptom thereof by administering a plasma kallikrein binding protein (e.g., a prophylactically effective amount of a plasma kallikrein binding protein) to a subject at risk of developing burn injuries (e.g., a subject whose occupation creates a risk of a burn injury, e.g., firefighter or cook).

Scales useful for assessing burns and symptoms of burns include, e.g., burn scales by degrees, by thickness, and by total body surface area (TBSA) (Meek et al. *J Burn Care Rehabil.* 12(6):564-8 (1991)) as well as other assessment tools known in the art.

Guidance for the determination of the dosage that delivers a therapeutically effective amount of a plasma kallikrein binding protein may be obtained from animal models of burn, such as a porcine burn model (Singer and McClain, Methods Mol. Med. 78:107-19 (2003), a sheep model of thermal injury (Jonkam et al., Shock, 28:704-709 (2007)), a rabbit model of thermal injury (Nwariaku et al., Burns, 22:324-327 (1996)), and a mouse model of burn wounding (Stevenson et al., Methods Mol. Med. 78:95-105 (2003)).

Combination Therapies

A plasma kallikrein binding protein described herein, e.g., an anti-plasma kallikrein antibody, e.g., an anti-plasma kallikrein Fab or IgG, can be administered in combination with one or more of the other therapies for treating a disease or condition associated with plasma kallikrein activity, e.g., a disease or condition described herein. For example, a plasma kallikrein binding protein can be used therapeutically or prophylactically with surgery, another anti-plasma kallikrein Fab or IgG (e.g., another Fab or IgG described herein), another plasma kallikrein inhibitor, a peptide inhibitor, or small molecule inhibitor. Examples of plasma kallikrein inhibitors that can be used in combination therapy with a plasma kallikrein binding protein described herein include plasma kallikrein inhibitors described in, e.g., WO 95/21601 or WO 2003/103475.

One or more plasma kallikrein inhibitors can be used in combination with one or more plasma kallikrein binding proteins described herein. For example, the combination can result in a lower dose of the inhibitor being needed, such that side effects are reduced.

A plasma kallikrein binding protein described herein can be administered in combination with one or more current therapies for treating a plasma kallikrein associated disease or condition, including, but not limited to the current therapies for treating the disorder, e.g., a current therapy for rheumatoid arthritis, gout, intestinal bowel disease, oral mucositis, neuropathic pain, inflammatory pain, spinal stenosis-degenerative spine disease, arterial or venous thrombosis, post operative ileus, aortic aneurysm, osteoarthritis, vasculitis, head trauma or peri-tumor brain edema, sepsis, acute middle cerebral artery (MCA) ischemic event (stroke), restenosis (e.g., after angioplasty), systemic lupus erythematosis nephritis, burn injury, or wound healing. For example, pKal inhibition is a novel mechanism of treating disease and therefore could provide effects that are synergistic or additive with other therapeutics. For example, a protein described herein that inhibits plasma kallikrein or that inhibits a downstream event of plasma kallikrein activity can also be used in combination with another treatment for a plasma kallikrein associated disease, such as surgery or administration of a second agent, e.g., as described herein. For example, the second agent can include ecallantide, a C1 esterase inhibitor (e.g., CINRYZE™), aprotinin (TRASYLOL®), a bradykinin B2 receptor inhibitor (e.g., icatibant (FIRAZYR®)).

The term "combination" refers to the use of the two or more agents or therapies to treat the same patient, wherein the use or action of the agents or therapies overlap in time. The agents or therapies can be administered at the same time (e.g., as a single formulation that is administered to a patient or as two separate formulations administered concurrently) or sequentially in any order. Sequential administrations are administrations that are given at different times. The time between administration of the one agent and another agent can be minutes, hours, days, or weeks. The use of a plasma kallikrein binding protein described herein can also be used to reduce the dosage of another therapy, e.g., to reduce the side effects associated with another agent that is being administered. Accordingly, a combination can include administering a second agent at a dosage at least 10, 20, 30, or 50% lower than would be used in the absence of the plasma kallikrein binding protein.

The second agent or therapy can also be another agent for a plasma kallikrein associated therapy. Non-limiting examples of another treatment for a plasma kallikrein associated disease or condition include, e.g., ecallantide, a C1 esterase inhibitor (e.g., CINRYZE™), aprotinin (TRASYLOL®), a bradykinin B2 receptor inhibitor (e.g., icatibant (FIRAZYR®)) or a second binding protein described herein.

A combination therapy can include administering an agent that reduces the side effects of other therapies. The agent can be an agent that reduces the side effects of a plasma kallikrein associated disease treatment. For example, for inflammatory diseases, a pKal inhibitor could be steroid sparring. Also, there could be synergism with a TNF-alpha inhibitor for treating inflammation or a VEGF blocker for treating cancer and/or angiogenesis.

Diagnostic Uses

A protein that binds to plasma kallikrein described herein can have in vitro and in vivo diagnostic utilities. A plasma kallikrein binding protein described herein (e.g., a protein that binds or binds and inhibits plasma kallikrein) can be used, e.g., for in vivo imaging, e.g., during a course of treatment for a disease or condition in which plasma kallikrein is active, e.g., a disease or condition described herein, or in diagnosing a disease or condition described herein.

In one aspect, the disclosure provides a diagnostic method for detecting the presence of plasma kallikrein, in vitro or in vivo (e.g., in vivo imaging in a subject). The method can include localizing plasma kallikrein within a subject or within a sample from a subject. With respect to sample evaluation, the method can include, for example: (i) contacting a sample with plasma kallikrein binding protein; and (ii) detecting the location of the plasma kallikrein binding protein in the sample.

A plasma kallikrein binding protein can also be used to determine the qualitative or quantitative level of expression of plasma kallikrein in a sample. The method can also include contacting a reference sample (e.g., a control sample, e.g., a negative control) with the binding protein, and determining a corresponding assessment of the reference sample. A difference (e.g., increase), e.g., a statistically significant difference, in the formation of the complex in the sample or subject relative to the control sample or subject can be indicative of the presence of plasma kallikrein in the sample. In one embodiment, the plasma kallikrein binding protein does not cross react with another kallikrein protein, such as tissue kallikrein and/or with plasma prekallikrein. E.g., the binding protein binds to another kallikrein protein or to prekallikrein 5- to 10-fold less well (or even less well) than it binds to plasma kallikrein. For example, the binding protein can bind to plasma kallikrein with a KD of ~10-50 pM, whereas it binds to tissue kallikrein and/or prekallikrein at ~10 nM.

The plasma kallikrein binding protein can be directly or indirectly labeled with a detectable substance to facilitate detection of the bound or unbound antibody. Suitable detectable substances include various enzymes, prosthetic groups, fluorescent materials, luminescent materials and radioactive materials.

Complex formation between the plasma kallikrein binding protein and plasma kallikrein can be detected by evaluating the binding protein bound to the plasma kallikrein or unbound binding protein. Conventional detection assays can be used, e.g., an enzyme-linked immunosorbent assays (ELISA), a radioimmunoassay (RIA) or tissue immunohistochemistry. Further to labeling the plasma kallikrein binding protein, the presence of plasma kallikrein can be assayed in a sample by a competition immunoassay utilizing standards labeled with a detectable substance and an unlabeled plasma kallikrein binding protein. In one example of this assay, the biological sample, the labeled standards, and the plasma kallikrein binding protein are combined and the amount of labeled standard bound to the unlabeled binding protein is determined. The amount of plasma kallikrein in the sample is inversely proportional to the amount of labeled standard bound to the plasma kallikrein binding protein.

Fluorophore and chromophore labeled proteins can be prepared. Because antibodies and other proteins absorb light having wavelengths up to about 310 nm, the fluorescent moieties should be selected to have substantial absorption at wavelengths above 310 nm and preferably above 400 nm. A variety of suitable fluorescers and chromophores are described by Stryer, 1968, Science 162:526 and Brand, L. et al., 1972, Annu. Rev. Biochem. 41:843-868. The proteins can be labeled with fluorescent chromophore groups by conventional procedures such as those disclosed in U.S. Pat. Nos. 3,940,475, 4,289,747, and 4,376,110. One group of fluorescers having a number of the desirable properties described above is the xanthene dyes, which include the fluoresceins and rhodamines. Another group of fluorescent compounds are the naphthylamines. Once labeled with a fluorophore or chromophore, the protein can be used to detect the presence or localization of the plasma kallikrein in a sample, e.g., using fluorescent microscopy (such as confocal or deconvolution microscopy).

Histological Analysis.

Immunohistochemistry can be performed using the proteins described herein. For example, in the case of an antibody, the antibody can be synthesized with a label (such as a purification or epitope tag), or can be detectably labeled, e.g., by conjugating a label or label-binding group. For example, a chelator can be attached to the antibody. The antibody is then contacted to a histological preparation, e.g., a fixed section of tissue that is on a microscope slide. After an incubation for binding, the preparation is washed to remove unbound antibody. The preparation is then analyzed, e.g., using microscopy, to identify if the antibody bound to the preparation.

Of course, the antibody (or other polypeptide or peptide) can be unlabeled at the time of binding. After binding and washing, the antibody is labeled in order to render it detectable.

Protein Arrays.

The plasma kallikrein binding protein can also be immobilized on a protein array. The protein array can be used as a diagnostic tool, e.g., to screen medical samples (such as isolated cells, blood, sera, biopsies, and the like). Of course, the protein array can also include other binding proteins, e.g., that bind to plasma kallikrein or to other target molecules.

Methods of producing polypeptide arrays are described, e.g., in De Wildt et al., 2000, Nat. Biotechnol. 18:989-994; Lueking et al., 1999, Anal. Biochem. 270:103-111; Ge, 2000, Nucleic Acids Res. 28, e3, I-VII; MacBeath and Schreiber, 2000, Science 289:1760-1763; WO 01/40803 and WO 99/51773A1. Polypeptides for the array can be spotted at high speed, e.g., using commercially available robotic apparati, e.g., from Genetic MicroSystems or BioRobotics. The array substrate can be, for example, nitrocellulose, plastic, glass, e.g., surface-modified glass. The array can also include a porous matrix, e.g., acrylamide, agarose, or another polymer.

For example, the array can be an array of antibodies, e.g., as described in De Wildt, supra. Cells that produce the proteins can be grown on a filter in an arrayed format. Polypeptide production is induced, and the expressed polypeptides are immobilized to the filter at the location of the cell. A protein array can be contacted with a labeled target to determine the extent of binding of the target to each immobilized polypeptide. Information about the extent of binding at each address of the array can be stored as a profile, e.g., in a computer database. The protein array can be produced in replicates and used to compare binding profiles, e.g., of a target and a non-target.

FACS (Fluorescence Activated Cell Sorting).

The plasma kallikrein binding protein can be used to label cells, e.g., cells in a sample (e.g., a patient sample). The binding protein is also attached (or attachable) to a fluorescent compound. The cells can then be sorted using fluorescence activated cell sorter (e.g., using a sorter available from Becton Dickinson Immunocytometry Systems, San Jose Calif.; see also U.S. Pat. Nos. 5,627,037; 5,030,002; and 5,137,809). As cells pass through the sorter, a laser beam excites the fluorescent compound while a detector counts cells that pass through and determines whether a fluorescent compound is attached to the cell by detecting fluorescence.

The amount of label bound to each cell can be quantified and analyzed to characterize the sample.

The sorter can also deflect the cell and separate cells bound by the binding protein from those cells not bound by the binding protein. The separated cells can be cultured and/or characterized.

In Vivo Imaging.

Also featured is a method for detecting the presence of plasma kallikrein expressing tissues in vivo. The method includes (i) administering to a subject (e.g., a patient having, e.g., a plasma kallikrein associated disease or condition) an anti-plasma kallikrein antibody, conjugated to a detectable marker; (ii) exposing the subject to a means for detecting said detectable marker to the plasma kallikrein expressing tissues or cells. For example, the subject is imaged, e.g., by NMR or other tomographic means.

Examples of labels useful for diagnostic imaging include radiolabels such as $^{131}$I, $^{111}$In, $^{123}$I, $^{99m}$TC, $^{32}$P, $^{125}$I, $^{3}$H, $^{14}$C, and $^{188}$Rh, fluorescent labels such as fluorescein and rhodamine, nuclear magnetic resonance active labels, positron emitting isotopes detectable by a positron emission tomography ("PET") scanner, chemiluminescers such as luciferin, and enzymatic markers such as peroxidase or phosphatase. Short range radiation emitters, such as isotopes detectable by short range detector probes can also be employed. The protein can be labeled with such reagents; for example, see Wensel and Meares, 1983, Radioimmunoimaging and Radioimmunotherapy, Elsevier, New York for techniques relating to the radiolabeling of antibodies and D. Colcher et al., 1986, *Meth. Enzymol.* 121: 802-816.

The binding protein can be labeled with a radioactive isotope (such as $^{14}$C, $^{3}$H, $^{35}$S, $^{125}$I, $^{32}$P, $^{131}$I). A radiolabeled binding protein can be used for diagnostic tests, e.g., an in vitro assay. The specific activity of a isotopically-labeled binding protein depends upon the half life, the isotopic purity of the radioactive label, and how the label is incorporated into the antibody.

In the case of a radiolabeled binding protein, the binding protein is administered to the patient, is localized to cells bearing the antigen with which the binding protein reacts, and is detected or "imaged" in vivo using known techniques such as radionuclear scanning using e.g., a gamma camera or emission tomography. See e.g., A. R. Bradwell et al., "Developments in Antibody Imaging", Monoclonal Antibodies for Cancer Detection and Therapy, R. W. Baldwin et al., (eds.), pp 65 85 (Academic Press 1985). Alternatively, a positron emission transaxial tomography scanner, such as designated Pet VI located at Brookhaven National Laboratory, can be used where the radiolabel emits positrons (e.g., $^{11}$C, $^{18}$F, $^{15}$O, and $^{13}$N).

MRI Contrast Agents.

Magnetic Resonance Imaging (MRI) uses NMR to visualize internal features of living subject, and is useful for prognosis, diagnosis, treatment, and surgery. MRI can be used without radioactive tracer compounds for obvious benefit. Some MRI techniques are summarized in EP-A-0 502 814. Generally, the differences related to relaxation time constants T1 and T2 of water protons in different environments are used to generate an image. However, these differences can be insufficient to provide sharp high resolution images.

The differences in these relaxation time constants can be enhanced by contrast agents. Examples of such contrast agents include a number of magnetic agents paramagnetic agents (which primarily alter T1) and ferromagnetic or superparamagnetic (which primarily alter T2 response). Chelates (e.g., EDTA, DTPA and NTA chelates) can be used to attach (and reduce toxicity) of some paramagnetic substances (e.g., $Fe^{+3}$, $Mn^{+2}$, $Gd^{+3}$). Other agents can be in the form of particles, e.g., less than 10 mm to about 10 nM in diameter). Particles can have ferromagnetic, antiferromagnetic, or superparamagnetic properties. Particles can include, e.g., magnetite ($Fe_3O_4$), $\gamma$-$Fe_2O_3$, ferrites, and other magnetic mineral compounds of transition elements. Magnetic particles may include: one or more magnetic crystals with and without nonmagnetic material. The nonmagnetic material can include synthetic or natural polymers (such as sepharose, dextran, dextrin, starch and the like.

The plasma kallikrein binding protein can also be labeled with an indicating group containing of the NMR active $^{19}$F atom, or a plurality of such atoms inasmuch as (i) substantially all of naturally abundant fluorine atoms are the $^{19}$F isotope and, thus, substantially all fluorine containing compounds are NMR active; (ii) many chemically active polyfluorinated compounds such as trifluoroacetic anhydride are commercially available at relatively low cost; and (iii) many fluorinated compounds have been found medically acceptable for use in humans such as the perfluorinated polyethers utilized to carry oxygen as hemoglobin replacements. After permitting such time for incubation, a whole body MRI is carried out using an apparatus such as one of those described by Pykett, 1982, *Sci. Am.* 246:78 88 to locate and image tissues expressing plasma kallikrein.

The following examples provide further illustration and are not limiting.

EXAMPLES

Example 1

We have discovered several antibody inhibitors and binders of plasma kallikrein (pKal). The most potent of these have been further characterized and shown to have apparent inhibition constants ($K_{i,app}$)<10 nM, to be specific pKal inhibitors with respect to other tested serine proteases, and to not bind prekallikrein. Amino acid sequences of the CDRs for the inhibitors and the binders are shown in Tables 1 and 2, respectively.

TABLE 1

CDR Amino Acid Sequences, ELISA Signal, and Apparent Inhibition Constant of Antibody Inhibitors of PKal (SEQ ID NOS 13-228, respectively, in order of appearance)

| Initial Name | Human pKal (Ki, nM) | Human pKal ELISAapp (T/B) | LV-CDR1 | LV-CDR2 | LV-CDR3 | HV-CDR1 | HV-CDR2 | HV-CDR3 |
|---|---|---|---|---|---|---|---|---|
| M6-D09 | 39.9 | 5.9 | RASQSIRNYLN | AASTLQS | QQLSGYPHT | FYYMV | VIYPSGGITVYADSVKG | DKWAVMPPYYYYAMDV |
| M7-B04 | 4.1 | 54 | TGTNSDVGNYNLVS | EVNKRPS | CSYAGNRNFYV | WYSMV | SISPSGGLTNYADSVKG | HTAARPFYYYYMDV |

TABLE 1-continued

CDR Amino Acid Sequences, ELISA Signal, and Apparent Inhibition Constant of Antibody Inhibitors of PKal (SEQ ID NOS 13-228, respectively, in order of appearance)

| Initial Name | Human pKal ELISA (T/B) | HumanpKal (Ki, app) nM | LV-CDR1 | LV-CDR2 | LV-CDR3 | HV-CDR1 | HV-CDR2 | HV-CDR3 |
|---|---|---|---|---|---|---|---|---|
| M7-E07 | 45.7 | 36 | SGDKLGDKYAC | QDSKRPS | QAWDSSTGV | WYLMI | YIYPSGGFTYYADSVKG | TEGPLSWGYGMDV |
| M8-A09 | 5.4 | 105 | SGDKLGNKYAY | QDNNRPS | QAWDSRTVV | TYFML | SIYPSGGNTVYADSVKG | AASPVRNYYYYGMDV |
| M10-F10 | 39.2 | <100 nM | RASQSISVYLN | GASNLQF | QQTFSLFT | FYNMN | SISPSGGETNYADSVKG | GGGAYRNNWWGGFDI |
| M10-H05 | 42.2 | 18 | RASQSVSSSYLA | GASSRAT | QQYGSSPFT | PYNMY | SIRPSGGGTVYADSVKG | GFIAARWYYFDY |
| M12-D05 | 48.5 | 5.2 | SGDQLGDKYVG | QDTKRPS | QAWDTSTAG | WYTMV | RIYPSGGWTKYADSVKG | EGLLWFGENAFDI |
| M27-E05 | 41.3 | 16 | SGDKLGDKYAC | QDSKRPS | QAWDSSTGV | WYLMI | YIYPSGGFTYYADSVKG | TEGPLSWGYGMDV |
| M28-B11 | 33.3 | 5.5 | SGDQLGDKYVG | QDTKRPS | QAWDTSTAG | WYTMV | RIYPSGGWTKYADSVKG | EGLLWFGENAFDI |
| M29-D09 | 47.5 | 0.7 | SGNKLGDKYVA | QDTKRPS | QAWDSSIVI | WYTMV | YIYPSGGATFYADSVKG | GSYDYIWGFYSDH |
| M29-E09 | 28.8 | 11 | SGDNLGNKYNS | QDTKRPS | QAWDGNVV | WYEMG | SIYSSGGGTMYADSVKG | NPQYSGYDRSLSDGAFDI |
| M35-G04 | 11.1 | 2.9 | RASQSVSSYLA | DASNRAT | QQRSNWPRGFT | YYHMS | VISPSGGSTKYADSVKG | GGSSDYAWGSYRRPYYFDY |
| M38-F02 | 33.5 | 14 | SGEKLGDKYVS | EDSRRPS | QAWDSSTAI | YYMMV | YIYSSGGHTVYADSVKG | DLFLYDFWSKGAFDI |
| M41-A11 | 28.0 | 13 | SGDKLGDKYTS | QDIKRPS | QAWDSPNARV | HYRMS | SIYPSGGRTVYADSVKG | DKFEWRLLFRGIGNDAFDI |
| M73-D06 | 4.0 | <100 nM | SGSSSNIGSNTVS | NDHRRPS | SAWDDSLNGVV | RYEMY | SISSSGGPTAYADSVKG | GTPKWELLLRSIYIENAFDI |
| M76-D01 | 11.2 | <100 nM | RSSQSLSDDGNTYLD | TLSYRAS | MQGTHWPPT | FYAMH | GIVPSGGRTHYADSVKG | DSSGSPNPLFDY |
| M110-C12 | 2.4 | <100 nM | RSSLSLLHSNGYNYLD | LSSTRAS | MQPLETPPT | YYEMD | GISSSGGHTAYADSVKG | ERRSSSRARYYYGMDV |
| M137-E12 | 4.5 | 79 | SGNNSNFGSNTVT | SDSRRPS | AAWDDSLNGV | DYRMQ | VIVPSGGNTMYADSVKG | GGPGSSIAARRAPTGYYGMDV |
| M142-H08 | 29.9 | 0.2 | RASQPIDNYLN | AASRLQS | QQSYTVPYT | AYSMI | YIRPSGGRTTYADSVKG | GGLLLWFRELKSNYFDY |
| M145-D01 | 6.2 | 1.1 | RASQSVSSYLA | DASNRAT | QQRSNWPRGFT | YYHMS | VISPSGGSTKYADSVKG | GGSSDYAWGSYRRPYYFDY |
| M145-D11 | 40.0 | 0.79 | SGDKLGDKYTS | QDIKRPS | QAWDSPNARV | HYRMS | SIYPSGGRTVYADSVKG | DKFEWRLLFRGIGNDAFDI |
| M146-E12 | 49.6 | 2.2 | RASGDIGNALG | DASTLQS | LQGYNYPRT | RYIMH | SISPSGGLTSYADSVKG | EFENAYHYYYYGMDV |
| M152-A12 | 19. | <100 nM | RASQSISSYLS | AASSLQS | QQSISIPRT | PYFMG | GIGPSGGSTTYADSVKG | EGPPYSSGWYRGLRQYHFDY |
| M160-G12 | 38.3 | 17 | RASQGISSYLA | AASTLQS | QQLNSYPLT | HYLMT | YISPSGGHTIYADSVKG | VARGIAARSRTSYFDY |
| M161-C11 | 41.8 | 0.3 | SGDKLGDKYVS | QDTKRPS | QAWDSSTYV | DYAMK | SISSSGGVTQYADSVKG | EEDYSSSWYSRRFDYYYGMDV |
| M162-A04 | 11.4 | 4.8 | RASQSISSWLA | KASTLES | QQYNTYWT | HYIMM | GIYSSGGITVYADSVKG | RRTGIPRRDAFDI |

TABLE 1-continued

CDR Amino Acid Sequences, ELISA Signal, and Apparent Inhibition Constant of Antibody Inhibitors of PKal (SEQ ID NOS 13-228, respectively, in order of appearance)

| Initial Name | Human pKal ELISA (T/B) | HumanpKal (Ki, app) nM | LV-CDR1 | LV-CDR2 | LV-CDR3 | HV-CDR1 | HV-CDR2 | HV-CDR3 |
|---|---|---|---|---|---|---|---|---|
| X67-B03 | nd | 2.1 | RASQPIDNYLN | AASRLQS | QQSYTVPYT | AYSMI | YIRPSGGRTTYADSVKG | GGLLLWSRELKSNYFDY |
| X67-C03 | nd | 0.7 | RASQPIDNYLN | AASRLQS | QQSYTVPYT | AYSMI | YIRPSGGRTTYADSVKG | GGLLLWFMELKSNYFDY |
| X67-C09 | nd | 8.6 | RASQPIDNYLN | AASRLQS | QQSYTVPYT | AYSMI | YIRPSGGRTTYADSVKG | GGLLLWGRELKSNYFDY |
| X67-D03 | nd | 0.1 | RASQPIDNYLN | AASRLQS | QQSYTVPYT | AYSMI | YIRPSGGRTTYADSVKG | GGLLLWNRELKSNYFDY |
| X67-E04 | nd | 1.3 | RASQPIDNYLN | AASRLQS | QQSYTVPYT | AYSMI | YIRPSGGRTTYADSVKG | GGLLLWDRELKSNYFDY |
| X67-F01 | nd | 0.9 | RASQPIDNYLN | AASRLQS | QQSYTVPYT | AYSMI | YIRPSGGRTTYADSVKG | GGLLLWQRELKSNYFDY |
| X67-F10 | nd | 1.3 | RASQPIDNYLN | AASRLQS | QQSYTVPYT | AYSMI | YIRPSGGRTTYADSVKG | GGLLLWTRELKSNYFDY |
| X67-G04 | nd | 0.35 | RASQPIDNYLN | AASRLQS | QQSYTVPYT | AYSMI | YIRPSGGRTTYADSVKG | GGLLLWARELKSNYFDY |
| X67-H04 | nd | 3.6 | RASQPIDNYLN | AASRLQS | QQSYTVPYT | AYSMI | YIRPSGGRTTYADSVKG | GGLLLWERELKSNYFDY |
| X81-B01 | nd | 0.2 | RTSQFVNSNYLA | GASSRAT | QQSSRTPWT | HYLMT | YISPSGGHTIYADSVKG | VARGIAARSRTPYFDY |

Abbreviations used: "T/B" is the ELISA signal obtained using of the "target" (biotinylated plasma kallikrein) divided by the ELISA signal of the "background" (streptavidin); both of which were coated on microtiter plates. "nd" is not determined. The symbol "q" refers to the amber suppressible stop codon (TAG), which is translated as glutamine (Q) in strains of *E. coli* such as the TG1 cells that were used to express the Fab fragments.

Amino acid sequences of light chain (LC) and heavy chain (HC) variable domain of pKal antibody inhibitors are shown below (SEQ ID NOS 229-298, respectively, in order of appearance).

```
M6-D09                  LC
QDIQMTQSPS SLSASVGDRV TITCRASQSI RNYLNWYQQK PGKAPNLLIY AASTLQSGVP        60

ARFSGSGSGT DFTLTISSLQ PEDFATYYCQ QLSGYPHTFG QGTKLEIK                    108

M6-D09                  HC
EVQLLESGGG LVQPGGSLRL SCAASGFTFS FYYMVWVRQA PGKGLEWVSV IYPSGGITVY        60

ADSVKGRFTI SRDNSKNTLY LQMNSLRAED TAVYYCARDK WAVMPPYYYY AMDVWGQGTT       120

VTVSSASTKG PSVFPLAPSS KS                                                142

M7-B04                  LC
QSALTQPASV SGSPGQSITI SCTGTNSDVG NYNLVSWYQQ HPGEAPKLLI YEVNKRPSGV        60

SNRFSGSKSG NTASLTISGL QAEDEADYLC CSYAGNRNFY VFGAGTKVTV L                111

M7-B04                  HC
EVQLLESGGG LVQPGGSLRL SCAASGFTFS WYSMVWVRQA PGKGLEWVSS ISPSGGLTNY        60

ADSVKGRFTI SRDNSKNTLY LQMNSLRAED TAVYYCARHT AARPFYYYYM DVWGKGTTVT       120

VSSASTKGPS VFPLAPSSKS                                                   140

M7-E07                  LC
QSELTQPPSV SVSPGQTASI TCSGDKLGDK YACWYQQKPG QSPVLVIYQD SKRPSGIPER        60

FSGSNSGNTA TLTISGTQAM DEADYYCQAW DSSTGVFGGG TKLTVL                      106
```

```
M7-E07                    HC
EVQLLESGGG LVQPGGSLRL SCAASGFTFS WYLMIWVRQA PGKGLEWVSY IYPSGGFTYY      60

ADSVKGRFTI SRDNSKNTLY LQMNSLRAED MAVYYCARTE GPLSWGYGMD VWGQGTTVTV     120

SSASTKGPSV FPLAPSSKS                                                  139

M8-A09                    LC
QCELTQPPSE SVSPGQTANI TCSGDKLGNK YAYWYQQKPG QSPVLVIYQD NNRPSGIPER      60

FSGSNSGNTA TLTISGTQAI DEANYYCQAW DSRTVVFGGG TKLTVL                    106

M8-A09                    HC
EVQLLESGGG LVQPGGSLRL SCAASGFTFS TYFMLWVRQA PGKGLEWVSS IYPSGGNTVY      60

ADSVKGRFTI SRDNSKNTLY LQMNSLRAED TAVYYCARAA SPVRNYYYYG MDVWGQGTTV     120

TVSSASTKGP SVFPLAPSSK S                                               141

M10-F10                   LC
QDIQMTQSPS SLSASVGDRV TITCRASQSI SVYLNWYQHK PGKAPKLLIY GASNLQFGVP      60

SRFSGSGYGT DFTLTISSLQ PEDFATYHCQ QTFSLFTFGG GTKVEIK                   107

M10-F10                   HC
EVQLLESGGG LVQPGGSLRL SCAASGFTFS FYNMNWVRQA PGKGLEWVSS ISPSGGETNY      60

ADSVKGRFTI SRDNSKNTLY LQMNSLRAED TAVYYCARGG GAYRNNWWGG FDIWGLGTMV     120

TVSSASTKGP SVFPLAPSSK S                                               141

M10-H05                   LC
QDIQMTQSPG TLSLSPGERA TLSCRASQSV SSSYLAWYQQ KPGQAPRLLI YGASSRATGI      60

PDRFSGSGSG TDFTLTISRL EPEDFAVYYC QQYGSSPFTF GPGTKVDIK                 109

M10-H05                   HC
EVQLLESGGG LVQPGGSLRL SCAASGFTFS PYNMYWVRQA PGKGLEWVSS IRPSGGGTVY      60

ADSVKGRFTI SRDNSKNTLY LQMNSLRAED TAVYYCAGGF IAARWYYFDY WGQGTLVTVS     120

SASTKGPSVF PLAPSSKS                                                   138

M12-D05                   LC
QSVLTQPPSV SVSPGQTATI TCSGDQLGDK YVGWYQQKPG QSPILVIYQD TKRPSGIPER      60

FSGSNSGNTA TLTISGTHTV DEAHYYCQAW DTSTAGFGGG TKLTVL                    106

M12-D05                   HC
EVQLLESGGG LVQPGGSLRL SCAASGFTFS WYTMVWVRQA PGKGLEWVSR IYPSGGWTKY      60

ADSVKGRFTI SRDNSKNTLY LQMNSLRAED TATYYCAREG LLWFGENAFD IWGQGTMVTV     120

SSASTKGPSV FPLAPSSKS                                                  139

M27-E05                   LC
QSELTQPPSV SVSPGQTASI TCSGDKLGDK YACWYQQKPG QSPVLVIYQD SKRPSGIPER      60

FSGSNSGNTA TLTISGTQAM DEADYYCQAW DSSTGVFGGG TKLTVL                    106

M27-E05                   HC
EVQLLESGGG LVQPGGSLRL SCAASGFTFS WYLMIWVRQA PGKGLEWVSY IYPSGGFTYY      60

ADSVKGRFTI SRDNSKNTLY LQMNSLRAED MAVYYCARTE GPLSWGYGMD VWGQGTTVTV     120

SSASTKGPSV FPLAPSSKS                                                  139

M28-B11                   LC
QSVLTQPPSV SVSPGQTATI TCSGDQLGDK YVGWYQQKPG QSPILVIYQD TKRPSGIPER      60

FSGSNSGNTA TLTISGTHTV DEAHYYCQAW DTSTAGFGGG TKLTVL                    106

M28-B11                   HC
EVQLLESGGG LVQPGGSLRL SCAASGFTFS WYTMVWVRQA PGKGLEWVSR IYPSGGWTKY      60

ADSVKGRFTI SRDNSKNTLY LQMNSLRAED TATYYCAREG LLWFGENAFD IWGQGTMVTV     120

SSASTKGPSV FPLAPSSKS                                                  139
```

```
M29-D09                 LC
QSALTQPPTV SVSPGQTARI TCSGNKLGDK YVAWYQQKPG QSPMLVIYQD TKRPSRVSER    60

FSGSNSANTA TLSISGTQAL DEADYYCQAW DSSIVIFGGG TRLTVL                  106

M29-D09                 HC
EVQLLESGGG LVQPGGSLRL SCAASGFTFS WYTMVWVRQA PGKGLEWVSY IYPSGGATFY    60

ADSVKGRFTI SRDNSKNTLY LQMNSLRAED TAVYYCAMGS YDYIWGFYSD HWGQGTLVTV   120

SSASTKGPSV FPLAPSSKS                                                139

M29-E09                 LC
QYELTQPPSV SVSPGQTATI TCSGDNLGNK YNSWYQQKPG QSPLLVIYQD TKRPSAIPER    60

FSGSNSGNTA TLTISGTQAM DEADYYCQAW DGNVVFGGGT KLTVL                   105

M29-E09                 HC
EVQLLESGGG LVQPGGSLRL SCAASGFTFS WYEMGWVRQA PGKGLEWVSS IYSSGGGTMY    60

ADSVKGRFTI SRDNSKNTLY LQMNSLRAED TAVYYCARNP QYSGYDRSLS DGAFDIWGQG   120

TMVTVSSAST KGPSVFPLAP SSKS                                          144

M35-G04                 LC
QDIQMTQSPA TLSLSPGERA TLSCRASQSV SSYLAWYQQK PGQAPRLLIY DASNRATGIP    60

ARFSGSGSGT DFTLTISSLE PEDFAVYYCQ QRSNWPRGFT FGPGTKVDIK              110

M35-G04                 HC
EVQLLESGGG LVQPGGSLRL SCAASGFTFS YYHMSWVRQA PGKGLEWVSV ISPSGGSTKY    60

ADSVKGRFTI SRDNSKNTLY LQMNSLRAED TAVYYCARGG SSDYAWGSYR RPYYFDYWGQ   120

GTLVTVSSAS TKGPSVFPLA PSSKS                                         145

M38-F02                 LC
QSVLTQPPSV SVSPGQTASI TCSGEKLGDK YVSWYQQKPG QSPSLVICED SRRPSGIPER    60

FSGSNSGNTA TLTISGAQPM DEADYYCQAW DSSTAIFGPG TKVTVL                  106

M38-F02                 HC
EVQLLESGGG LVQPGGSLRL SCAASGFTFS YYMMVWVRQA PGKGLEWVSY IYSSGGHTVY    60

ADSVKGRFTI SRDNSKNTLY LQMNSLRAED TAVYYCARDL FLYDFWSKGA FDIWGQGTMV   120

TVSSASTKGP SVFPLAPSSK S                                             141

M41-A11                 LC
QSVLTQPPSV SVSPGQTASI TCSGDKLGDK YTSWYQQRPG QSPVLVIYQD IKRPSGIPER    60

FSGSNSGNTA TLTISGTQAM DEADYYCQAW DSPNARVFGS GTKVTVL                 107

M41-A11                 HC
EVQLLESGGG LVQPGGSLRL SCAASGFTFS HYRMSWVRQA PGKGLEWVSS IYPSGGRTVY    60

ADSVKGRFTI SRDNSKNTLY LQMNSLRAED TAVYYCAKDK FEWRLLFRGI GNDAFDIWGQ   120

GTMVTVSSAS TKGPSVFPLA PSSKS                                         145

M73-D06                 LC
QSELTQPPSA SETPGQRVTI SCSGSSSNIG SNTVSWFQQL PGSAPRLLIY NDHRRPSGVP    60

DRFSGSKSGT SASLVISGLQ SQDEADYYCS AWDDSLNGVV FGGGTKLTVL              110

M73-D06                 HC
EVQLLESGGG LVQPGGSLRL SCAASGFTFS RYEMYWVRQA PGKGLEWVSS ISSSGGPTAY    60

ADSVKGRFTI SRDNSKNTLY LQMNSLRAED TAMYYCAKGT PKWELLLRSI YIENAFDIWG   120

QGTMVTVSSA STKGPSVFPL APSSKS                                        146

M76-D01                 LC
QDIVMTQTPP SLPVNPGEPA SISCRSSQSL SDDGNTYLDW YLQRPGQSPQ LLIHTLSYRA    60

SGVPDRFSGS GSGTDFTLKI SRVEAEDVGV YYCMQGTHWP PTFGQGTKVE IK           112
```

-continued

```
M76-D01                  HC
EVQLLESGGG LVQPGGSLRL SCAASGFTFS FYAMHWVRQA PGKGLEWVSG IVPSGGRTHY      60

ADSVKGRFTI SRDNSKNTLY LQMNSLRAED TAVYYCATDS SGSPNPLFDY WGQGTLVTVS     120

SASTKGPSVF PLAPSPKS                                                   138

M110-C12                 LC
QDIQMTQSPL SLSVTPGEPA SISCRSSLSL LHSNGYNYLD WYVQRPGQSP QLLMYLSSTR      60

ASGVPDRFSG SGSGTDFTLE ISRVEAEDVG VYYCMQPLET PPTFGGGTKV EIK            113

M110-C12                 HC
EVQLLESGGG LVQPGGSLRL SCAASGFTFS YYEMDWVRQA PGKGLEWVSG ISSSGGHTAY      60

ADSVKGRFTI SRDNSKNTLY LQMNSLRAED TATYYCARER RSSSRARYYY GMDVWGQGTT     120

VTVSSASTKG PSVFPLAPSS KS                                              142

M137-E12                 LC
QSVLIQPPSV SGIPGQRVTI SCSGNNSNFG SNTVTWYQQL PGTAPKLLIY SDSRRPSGVP      60

DRFSGSRSDT SASLAISGLQ SEDEAEYHCA AWDDSLNGVF GGGTKLTVL                 109

M137-E12                 HC
EVQLLESGGG LVQPGGSLRL SCAASGFTFS DYRMQWVRQA PGKGLEWVSV IVPSGGNTMY      60

ADSVKGRFTI SRDNSKNTLY LQMNSLRAED TAVYYCARGG PGSSIAARRA PTGYYGMDVW     120

GQGTTVTVSS ASTKGPSVFP LAPSSKS                                         147

M142-H08                 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                  108

M142-H08                 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWFRELKS NYFDYWGQGT     120

LVTVSSASTK GPSVFPLAPS SKS                                             143

M145-D01                 LC
QDIQMTQSPA TLSLSPGERA TLSCRASQSV SSYLAWYQQK PGQAPRLLIY DASNRATGIP      60

ARFSGSGSGT DFTLTISSLE PEDFAVYYCQ QRSNWPRGFT FGPGTKVDIK                110

M145-D01                 HC
EVQLLESGGG LVQPGGSLRL SCAASGFTFS YYHMSWVRQA PGKGLEWVSV ISPSGGSTKY      60

ADSVKGRFTI SRDNSKNTLY LQMNSLRAED TAVYYCARGG SSDYAWGSYR RPYYFDYWGQ     120

GTLVTVSSAS TKGPSVFPLA PSSKS                                           145

M145-D11                 LC
QSVLTQPPSV SVSPGQTASI TCSGDKLGDK YTSWYQQRPG QSPVLVIYQD IKRPSGIPER      60

FSGSNSGNTA TLTISGTQAM DEADYYCQAW DSPNARVFGS GTKVTVL                   107

M145-D11                 HC
EVQLLESGGG LVQPGGSLRL SCAASGFTFS HYRMSWVRQA PGKGLEWVSS IYPSGGRTVY      60

ADSVKGRFTI SRDNSKNTLY LQMNSLRAED TAVYYCAKDK FEWRLLFRGI GNDAFDIWGQ     120

GTMVTVSSAS TKGPSVFPLA PSSKS                                           145

M146-E12                 LC
QDIQMTQSPS SLSASVGDRV TITCRASGDI GNALGWYQQK PGKAPRLLIS DASTLQSGVP      60

LRFSGSGSGT EFTLTISSLQ PEDFATYYCL QGYNYPRTFG QGTKLEIR                  108

M146-E12                 HC
EVQLLESGGG LVQPGGSLRL SCAASGFTFS RYIMHWVRQA PGKGLEWVSS ISPSGGLTSY      60

ADSVKGRFTI SRDNSKNTLY LQMNSLRAED TAVYYCAREF ENAYHYYYG MDVWGQGTTV      120

TVSSASTKGP SVFPLAPSSK S                                               141
```

```
M152-A12                 LC
QDIQMTQSPS SLSASVGDRV TITCRASQSI SSYLSWYQQR PGKAPNLLIY AASSLQSGVP      60

SRFSGSGSGT DFTLTISSLQ PEDFATYYCQ QSISIPRTFG QGTKVEVK                  108

M152-A12                 HC
EVQLLESGGG LVQPGGSLRL SCAASGFTFS PYFMGWVRQA PGKGLEWVSG IGPSGGSTTY      60

ADSVKGRFTI SRDNSKNTLY LQMNSLRAED TAVYYCAREG PPYSSGWYRG LRQYHFDYWG     120

QGTLVTVSSA STKGPSVFPL APSSKS                                         146

M160-G12                 LC
QDIQMTQSPS FLSASVGDRV TITCRASQGI SSYLAWYQQK PGKAPKLLIY AASTLQSGVP      60

SRFSGSGSGT EFTLTISSLQ PEDFATYYCQ QLNSYPLTFG GGTKVEIK                 108

M160-G12                 HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIAARSRTS YFDYWGQGTL    120

VTVSSASTKG PSVFPLAPSS KS                                             142

M161-C11                 LC
QSALTQPPSV SVSPGQTASI TCSGDKLGDK YVSWYQQRPG QSPVLVIYQD TKRPSGIPER      60

FSGSNSGNTA TLTISGTQAV DEADYYCQAW DSSTYVFGGG TKVTVL                   106

M161-C11                 HC
EVQLLESGGG LVQPGGSLRL SCAASGFTFS DYAMKWVRQA PGKGLEWVSS ISSSGGVTQY      60

ADSVKGRFTI SRDNSKNTLY LQMNSLRAED TAVYYCAREE DYSSSWYSRR FDYYYGMDVW    120

GQGTTVTVSS ASTKGPSVFP LAPSSKS                                        147

M162-A04                 LC
QDIQMTQSPS TLSASVGDRV TITCRASQSI SSWLAWYQQK PGKAPNLLIY KASTLESGVP      60

SRFSGSGSGT EFTLTISSLQ PDDFATYYCQ QYNTYWTFGQ GTKVEIK                  107

M162-A04                 HC
EVQLLESGGG LVQPGGSLRL SCAASGFTFS HYIMMWVRQA PGKGLEWVSG IYSSGGITVY      60

ADSVKGRFTI SRDNSKNTLY LQMNSLRAED TAVYYCAYRR TGIPRRDAFD IWGQGTMVTV    120

SSASTKGPSV FPLAPSSKS                                                 139

X67-B03 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                 108

X67-B03 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWSRELKS NYFDYWGQGT    120

LVTVSSASTK GPSVFPLAPS SKS                                            143

X67-C03 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                 108

X67-C03 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWMRELKS NYFDYWGQGT    120

LVTVSSASTK GPSVFPLAPS SKS                                            143

X67-C09 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                 108
```

```
X67-C09 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWGRELKS NYFDYWGQGT     120

LVTVSSASTK GPSVFPLAPS SKS                                            143

X67-D03 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                 108

X67-D03 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWNRELKS NYFDYWGQGT     120

LVTVSSASTK GPSVFPLAPS SKS                                            143

X67-E04 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                 108

X67-E04 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWDRELKS NYFDYWGQGT     120

LVTVSSASTK GPSVFPLAPS SKS                                            143

X67-F01 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                 108

X67-F01 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWQRELKS NYFDYWGQGT     120

LVTVSSASTK GPSVFPLAPS SKS                                            143

X67-F10 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                 108

X67-F10 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWTRELKS NYFDYWGQGT     120

LVTVSSASTK GPSVFPLAPS SKS                                            143

X67-G04 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                 108

X67-G04 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWARELKS NYFDYWGQGT     120

LVTVSSASTK GPSVFPLAPS SKS                                            143

X67-H04 LC
QDIQMTQSPS SLSAFVGDRV TITCRASQPI DNYLNWYHQK PGKAPKLLIY AASRLQSGVP      60

SRLSGSGFGT DFTLTISSLQ PEDFGNYYCQ QSYTVPYTFG GGTKVEIR                 108

X67-H04 HC
EVQLLESGGG LVQPGGSLRL SCAASGFTFS AYSMIWVRQA PGKGLEWVSY IRPSGGRTTY      60

ADSVKGRFTI SRDNSKNTLY LQMNSLRAED TAVYYCARGG LLLWERELKS NYFDYWGQGT     120

LVTVSSASTK GPSVFPLAPS SKS                                            143
```

Note:
X81-B01 is a germilined IgG derived from X63-G06 which is shown in Table 7.

TABLE 2

CDR Amino Acid Sequences and ELISA Signal of Antibody Binders of PKal
(SEQ ID NOS 299-748, respectively, in order of appearance)

| Initial Name | Human pKal ELISA (T/B) | LV-CDR1 | LV-CDR2 | LV-CDR3 | HV-CDR1 | HV-CDR2 | HV-CDR3 |
|---|---|---|---|---|---|---|---|
| M6-A06 | 11.7 | RASQSISMYLN | GTSSLQS | QQSYSAPWT | LYQMTGIWPSGGFTDYADSVKG | | VSTAVADNDY |
| M6-A08 | 23.4 | RASQRISFYLN | GASSLQS | QQTFSTPNT | PYPMQSISSSGGMTEYADSVKG | | DDYGGKGGAFDI |
| M6-D03 | 15.5 | RASQSISSYLN | AASSLQS | QQSYSTLWT | KYFMGVIGSSGGWTSYADSVKG | | VSTAVADNDY |
| M6-D08 | 16 | RASQSISSYLN | GASSLQS | QQSYTRWT | RYHMVSISPSGGWTNYADSVKG | | EMATIAGQFDP |
| M6-G05 | 18.5 | RASQSISTYLN | NAFSMER | QQSYTTPTT | RYRMVSIYPSGGMTAYADSVKG | | DAVGIGDAFDI |
| M8-C04 | 44.7 | SGDKLGDKYTS | QDSKRPS | QAWDSSTV | YYPMQYIYPSGGLTSYADSVKG | | LFYGSGSVGFEY |
| M8-D05 | 11.9 | RASQDISSWLV | DASNLQS | QQADGFPLT | LYNMNSISPSGGFTDYADSVKG | | DLDLGILDY |
| M8-E06 | 8.8 | RASQSISSYLN | AASSLQS | QQSYSTLMYT | HYFMTSIVPSGGMTQYADSVKG | | DSYSSSWFDI |
| M8-G09 | 28.2 | RASQGVSYYLA | GASSLQS | QQYNTYPPT | LYEMLVIYPSGGYTDYADSVKG | | SFSGFGEIDY |
| M8-H04 | 3.3 | RASQYISTYLN | GTSSLQS | QQSFTTPFT | GYWMGSISSSGGWTQYADSVKG | | DDEIAAGGAFDI |
| M9-A03 | 14.4 | RASQNIDIYLN | GAYNLQS | QQSYGTPV | GYFMMSIYSSGGYTDYADSVKG | | EVAGTYAFDI |
| M9-A08 | 5.5 | RASQRISTYLN | GASSLQS | QQSYNTPRT | AYEMWYIGSSGGSTSYADSVKG | | GNSSSFDAFDI |
| M9-C08 | 10.9 | RASQSISIYVN | AASSLQR | QQSFSTPLT | HYGMVYIVPSGGLTYYADSVKG | | VDYTGDGLGY |
| M9-C10 | 7.8 | RASQGISSYLN | GASSLQS | QESYSTLFT | LYPMQSIGSSGGMTFYADSVKG | | EVGAAGFAFDI |
| M9-D08 | 35.9 | RASRTISFYLN | GGSSLHS | QQSFSSPWT | WYKMMSIYPSGGWTNYADSVKG | | GSPWGDDAFDI |
| M9-E04 | 18.8 | RASQSISGYLN | AASNLQT | QQSHTPPKT | EYDMMSIGSSGGMTYYADSVKG | | DQVAAAAIDY |
| M9-F08 | 10.9 | RASQSISSYLN | AASSLQS | QQSYSTPPYT | PYAMTVIYPSGGFTDYADSVKG | | ASGSYLDAFDI |
| M9-F09 | 7 | RASQSISSYLN | AASSLQS | QQTYTTPWT | SYPMGRISSSGGMTIYADSVKG | | DDWNVGMDV |
| M9-F10 | 8.4 | RASQSINTYLN | AASTLES | QQSYSTPYT | DYDMESISPSGGSTIYADSVKG | | QGLLTAFDI |
| M9-G08 | 4.8 | RASQSISSYLN | AASSLQS | QQSYSTPIT | YYTMLSIYPSGGFTMYADSVKG | | VDTAMAMIDY |
| M9-H02 | 3.5 | RASRSIATYLN | GASTLQS | QQSFSDPYT | AYMMIVIYPSGGVTMYADSVKG | | GTVGASDAFDI |
| M9-H03 | 4.4 | SGDKLGNRYTS | QDNKRPS | QALDSNTYV | WYSMGYIVPSGGYTMYADSVKG | | DPGVSYYYYGMDV |
| M9-H04 | 16.1 | RASQSISSYLN | AASSLQS | QQSYSTPPT | AYTMWSIWPSGGSTFYADSVKG | | TYDSSAGEVDY |
| M10-A03 | 33.7 | RASQRISFYLN | GASSLQS | QQTFSTPNT | PYPMQSISSSGGMTEYADSVKG | | DDYGGKGGAFDI |
| M10-A12 | 20.8 | RASRDISVYLN | GASSLQS | QQSYSIPFT | LYLMHSIYSSGGFTTYADSVKG | | DTDYGMDV |
| M10-B09 | 14.1 | RASQSISTYLN | GASSLQS | QQSFSTPWT | WYEMSRIWPSGGVTMYADSVKG | | TSITTVGMDV |
| M10-C11 | 5.3 | RASQSISIYLN | AASTLQS | QQSHSIPPT | MYPMMYISPSGGMTDYADSVKG | | VAGSSDAFDI |
| M10-D11 | 6.4 | RSSQSLLHSNGYNYLD | LGSNRAS | MQALQTPLT | AYPMNRISSSGGNTSYADSVKG | | GYLGY |
| M10-E06 | 32.8 | RASQSISTYLN | GASSLQS | QQSYSDPYT | LYRMFSIWSSGGPTMYADSVKG | | EYPSTYYFDY |
| M10-F09 | 4.8 | RASQTIDDDLI | AASSLQS | QQSYNIPRT | NYDMMYISPSGGFTRYADSVKG | | DIYYYNWGPSHYFDS |
| M10-G09 | 7.1 | RASQSISGYIN | AASSLQS | QQYVSYPFT | QYGMQSIRSSGGATRYADSVKG | | DGYYDSSGYPDY |
| M11-A10 | 25 | RASQSIDTYLN | DASNL | QHYLYAPYS | NYWMMGISSGGGFTSYADSVKG | | GSYSDYGVFES |
| M11-E01 | 11.7 | RASQSISSYLN | AASSLQS | QQSYSTPPT | TYEMYGIGSSGGMTMYADSVKG | | EQPGIAALQF |

TABLE 2-continued

CDR Amino Acid Sequences and ELISA Signal of Antibody Binders of PKal
(SEQ ID NOS 299-748, respectively, in order of appearance)

| Initial Name | Human pKal ELISA (T/B) | LV-CDR1 | LV-CDR2 | LV-CDR3 | HV-CDR1 | HV-CDR2 | HV-CDR3 |
|---|---|---|---|---|---|---|---|
| M11-E04 | 43.2 | RASQSISIYLT | GAATLQT | QQTFSLPRT | MYHMNGIVSSGGVTFYADSVKG | | ITTVTTGGAFDI |
| M11-E05 | 41.4 | RTSQTINNYLN | ATHTLES | QQSFAFPYT | WYTMGWIYFGGLTTYADSVKG | | LGGPLDAFDI |
| M11-E06 | 12.6 | RASRGIGTYLN | AASSLET | QESFTNVYN | QYAMHSIYPSGGFTLYADSVKG | | GGWLAGGELLN |
| M11-G09 | 23.6 | RTSQGINHYLN | AASELQT | QQTYTSPYT | LYNMTYIYPSGGGTHYADSVKG | | DTGFWSADAFDI |
| M11-G12 | 4.9 | RASQTISVYVN | GASSLQS | QQSYSIPFT | QYPMNSISSSGGFTTYADSVKG | | EEQQGGFDY |
| M12-A08 | 40.4 | RASQSISRYLN | AASTLET | QQSYSTPYT | WYYMGWIVSSGGLTLYADSVKG | | TTVTTGDAFDI |
| M12-B04 | 18 | RASQGIRNDLG | AASILQS | LQDYEYPLT | LYSMYRIRPSGGGTVYADSVKG | | DPLYSSGDV |
| M12-C09 | 7 | RASQSIGIYLN | GASSLQS | QHSYSTPFT | SYAMVSIGSSGGFTLYADSVKG | | MNLGGGDAFDI |
| M12-C10 | 8.3 | SGDKLGEKYVS | QDNKRPS | QAWDSYTVV | DYEMHGISPSGGKTQYADSVKG | | DLKWGGRGSPDWYFDL |
| M12-D10 | 9.9 | RASQSISSYLN | AASSLQS | QQSYSTPPT | NYPMDSISSSGGWTNYADSVKG | | DTSGSYLGFDY |
| M12-E06 | 48 | RASQSISTYLN | GAFSLQS | QQSHSTPPT | QYKMLGIGPSGGLTAYADSVKG | | APWFGELGMDV |
| M27-A10 | 3.2 | RASQSISAYLN | YGVGSLQS | QQGYTTPVT | WYRMDSIWPSGGLTSYADSVKG | | GWAPGGDAFDI |
| M27-B01 | 33.1 | RASQSISSYLN | AASSLQS | QQSYSTPYT | DYTMWSISSSGGITFYADSVKG | | SADTAMGGAFDI |
| M27-B12 | 2.3 | SGDKLGDEYAA | QDRKRPS | QAWGKRNVV | WYQMMSISPSGGITEYADSVKG | | DRSSGWYYYGMDV |
| M27-E03 | 35.9 | RASQSISSYLN | AASSLQS | QQSYSTPRT | SYMMHGIYPSGGWTDYADSVKG | | LVAGLDAFDI |
| M27-F04 | 10.5 | RASQSISSYLN | AASSLQS | QQSYSTPPT | WYPMTSIGPSGGQTIYADSVKG | | EYGDYGGGFDP |
| M27-F11 | 10 | RASQGISSYLA | AASSLQS | QQSYNTLRT | SYHMMSIYPSGGATMYADSVKG | | DGYHYGDYTYFQH |
| M27-G01 | 31.4 | RASQSISTYLN | GASSLQS | QQSYSDPYT | LYRMFSIWSSGGPTMYADSVKG | | EYPSTYYFDY |
| M27-G04 | 4.1 | RASQRISYYLT | AASSLES | QQAFSTPFT | AYYMVYISPSGGQTQYADSVKG | | EAISSSSFDY |
| M27-G09 | 2.2 | RTRQSISNYLN | AASSLQS | QQSYDIPFT | EYDMAYIVSSGGFTSYADSVKG | | WAGWIAAADY |
| M27-H10 | 12.4 | RASQSISNYLN | AASSLQS | QQSYSTPQT | AYQMAVIYSSGGYTDYADSVKG | | HNWNDGAFDI |
| M28-A01 | 19 | RASQSISSYLN | AASSLQS | QQSYSTLT | WYAMHGIYSSGGYTKYADSVKG | | DLSNGDDVFDI |
| M28-C03 | 2.2 | RASQSINFYLN | VASSLES | LQSYSAPYT | YYQMGSIYPSGGMTDYADSVKG | | GSPWGDDAFDI |
| M28-D02 | 3.7 | RTSRRIGTYLN | GASSLQS | QQSFSSPWT | WYPMQYIYPSGGGTDYADSVKG | | SSGWLGDAFDI |
| M28-D12 | 41.6 | RASQSIATYLN | AASSLQS | QQSYSTRET | WYTMHVIYPSGGPTSYADSVKG | | DGSGSYLGFDY |
| M28-E01 | 41 | RASQSISSYLN | AASSLQS | QQTYTTPWT | SYPMGRISSSGGMTIYADSVKG | | DDWNVGMDV |
| M28-E11 | 29.3 | RASQDISNWLA | AASSLQT | QQSYSLPWT | LYDMTGISSSGGVTIYADSVKG | | TYYYDSSGYADAFDI |
| M28-F01 | 1.5 | RASQSINTYLN | AASTLES | QQSYSTPPT | VYLMHGISPSGGYTQYADSVKG | | PGGLDAFDI |
| M28-F05 | 31.4 | RASQSISSYLN | AASSLQS | QQSYSTPLT | RYIMWGIYSSGGYTQYADSVKG | | ELEGLGGFDY |
| M28-F07 | 33 | RASQGISSWLA | ATSGLQS | QQAKSFPLT | DYTMYSIVPSGGHTLYADSVKG | | DHLSSWYGGFFDY |
| M29-C07 | 5.2 | RASQSISSYLN | AASSLQS | QQSYSTRYT | GYDMMVISSSGGNTAYADSVKG | | ESSGLYYFDY |
| M29-D10 | 23.6 | RASQSITIYLN | GASNLHS | QQSYDTPLT | WYPMYSIGSSGGPTPYADSVKG | | WADYGGSLDY |
| M29-E02 | 2 | SGSSSNIGNNAVS | YDDLLPS | AAWDDSLNGFV | RYPMMVIYPSGGDTFYADSVKG | | GDDYLWEAAVY |
| M29-G08 | 40.4 | RASQNIGNDVA | HASTRAY | QQFYDWPAHT | YYHMWGISPSGGFTFYADSVKG | | DYYYDSSGYSPLGY |
| M29-G10 | 16.4 | RASQSISIYLN | GASQLES | QQSYNVPYT | FYKMISISSSGGSTQYADSVKG | | DRVDLGYLDY |
| M74-A07 | 8.6 | RTSQNINTYLN | GVSSLHR | QQSYSSPWT | QYLMMSIYPSGGYTSYADSVKG | | VSTAVADNDY |

TABLE 2-continued

CDR Amino Acid Sequences and ELISA Signal of Antibody Binders of PKal
(SEQ ID NOS 299-748, respectively, in order of appearance)

| Initial Name | Human pKal ELISA (T/B) | LV-CDR1 | LV-CDR2 | LV-CDR3 | HV-CDR1 | HV-CDR2 | HV-CDR3 |
|---|---|---|---|---|---|---|---|
| M76-F02 | 6.4 | RASQTIDNYLH | DASSLQS | QQSYDTPQYT | LYDMN | GISPSGGQTMYADSVKG | QPMISAFDI |
| M76-G02 | 10.3 | RASQSISSYLN | AASSLQS | QQSYSTPPWT | LYAMW | YISSSGGFTSYADSVKG | YRVGVAATDY |
| M76-G06 | 11.8 | RASQSISTYLN | AASSLQS | QQSYSTPHT | GYIMH | WIYPSGGWTEYADSVKG | DAPGVGAIDY |
| M76-H02 | 13.4 | RASQDISVYLN | GGASLQS | QQSYSLPFT | MYWMQ | YIYPSGGPTKYADSVKG | PSGSYGDAFDI |
| M77-C07 | 16.1 | RASQNISSYLN | AASSLQS | QQSYSTPRT | LYIMG | GIYPSGGFTMYADSVKG | ESSGVAAPDY |
| M77-H04 | 7.6 | RSSQSLLHSRGYNYLD | LGSNRAS | MQALQRRT | YYTMI | GIRSSGGGTRYADSVKG | DGSRYSYGSIYYYYGMDA |

Abbreviations used: "T/B" is the ELISA signal obtained using of the "target" (biotinylated plasma kallikrein) divided by the ELISA signal of the "background" (streptavidin); both of which were coated on microtiter plates. "nd" is not determined. The symbol "q" refers to the amber suppressible stop codon (TAG), which is translated as glutamine (Q) in strains of E. coli such as the TG1 cells that were used to express the Fab fragments.

Amino acid sequences of light chain (LC) and heavy chain (HC) variable domain of pKal antibody binders are shown below (SEQ ID NOS 749-898, respectively, in order of appearance).

```
M6-A06              LC
QDIQMTQSPS SLSASVGDSV TISCRASQSI SMYLNWYQHK PGKAPKLLIY GTSSLQSGVP    60

SRFSGSGPGG TDFTLTISSL QPEDFATYYC QQSYSAPWTF GQGTKVEIK              109

M6-A06              HC
EVQLLESGGG LVQPGGSLRL SCAASGFTFS LYQMTWVRQA PGKGLEWVSG IWPSGGFTDY    60

ADSVKGRFTI SRDNSKNTLY LQMNSLRAED TAVYYCARVS TAVADNDYWG QGTLVTVSSA   120

STKGPSVFPL APSSKS                                                  136

M6-A08              LC
QDIQMTQSPS SLSASVGDRV TITCRASQRI SFYLNWFQQK PGKAPNLLIY GASSLQSGVP    60

SRFSGSGSGT DFTLTISSLQ PKDFGTYYCQ QTFSTPNTFG QGTKLEIK               108

M6-A08              HC
EVQLLESGGG LVQPGGSLRL SCAASGFTFS PYPMQWVRQA PGKGLEWVSS ISSSGGMTEY    60

ADSVKGRFTI SRDNSKNTLY LQMNSLRAED TAVYYCARDD YGGKGGAFDI WGQGTMVTVS   120

SASTKGPSVF PLAPSSKS                                                138

M6-D03              LC
QDIQMTQSPS SLSASVGDRV TITCRASQSI SSYLNWYQQK PGKAPKLLIY AASSLQSGVP    60

SRFSGSGSGT DFTLTISSLQ PEDFATYYCQ QSYSTLWTFG QGTKVEIK               108

M6-D03              HC
EVQLLESGGG LVQPGGSLRL SCAASGFTFS KYFMGWVRQA PGKGLEWVSV IGSSGGWTSY    60

ADSVKGRFTI SRDNSKNTLY LQMNSLRAED TAVYYCARVS TAVADNDYWG QGTLVTVSSA   120

STKGPSVFPL APSSKS                                                  136

M6-D08              LC
QDIQMTQSPS SLSASVGDRV TITCRASQSI SSYLNWYqQK PGKAPKLLIY GASSLQSGVP    60

SRFSGSGSGT DFTLTISSLQ PEDSATYYCQ QSYTRWTFGQ GTKVEIK                107

M6-D08              HC
EVQLLESGGG LVQPGGSLRL SCAASGFTFS RYHMVWVRQA PGKGLEWVSS ISPSGGWTNY    60

ADSVKGRFTI SRDNSKNTLY LQMNSLRAED TAMYYCAREM ATIAGQFDPW GQGTLVTVSS   120

ASTKGPSVFP LAPSSKS                                                 137
```

```
M6-G05              LC
QDIQMTQSPS SLSASVGDRV TITCRASQSI STYLNWYQLK PGKAPKLLIY NAFSMERGVP    60

STISGSGSGT DFTLTISSLQ PEDFATYYCQ QSYTTPTTFG QGTKVEIK                108

M6-G05              HC
EVQLLESGGG LVQPGGSLRL SCAASGFTFS RYRMVWVRQA PGKGLEWVSS IYPSGGMTAY    60

ADSVKGRFTI SRDNSKNTLY LQMNSLRAED TAVYYCARDA VGIGDAFDIW GQGTMVTVSS   120

ASTKGPSVFP LAPSSKS                                                  137

M8-C04              LC
QSALTQPPSV SVSPGQTASI TCSGDKLGDK YTSWHQQKPG QSPVLVIYQD SKRPSGIPER    60

FSGSNSGNTA TLTISGTQAM DEADYYCQAW DSSTVFGGGT RLTVL                   105

M8-C04              HC
EVQLLESGGG LVQPGGSLRL SCAASGFTFS YYPMQWVRQA PGKGLEWVSY IYPSGGLTSY    60

ADSVKGRFTI SRDNSKNTLY LQMNSLRAED TAVYYCARLF YGSGSVGFEY WGQGTLVTVS   120

SASTKGPSVF PLAPSSKS                                                 138

M8-D05              LC
QDIQMTQSPS FVSASVGDRV TITCRASQDI SSWLVWYQQK PGKPKLLIY DASNLQSGVP     60

SRFSGGGSGT HFTLTISSLQ PEDFATYYCQ QADGFPLTFG GGTKVEMK                108

M8-D05              HC
EVQLLESGGG LVQPGGSLRL SCAASGFTFS LYNMNWVRQA PGKGLEWVSS ISPSGGFTDY    60

ADSVKGRFTI SRDNSKNTLY LQMNSLRAED TAVYYCARDL DLGILDYWGQ GTLVTVSSAS   120

TKGPSVFPLA PSSKS                                                    135

M8-E06              LC
QDIQMTQSPS SLSASVGDRV TITCRASQSI SSYLNWYQQK PGKAPKLLIY AASSLQSGVP    60

SRFSGSGSGT DFTLTISSLQ PEDFATYYCQ QSYSTLMYTF GQGTKLEIK               109

M8-E06              HC
EVQLLESGGG LVQPGGSLRL SCAASGFTFS HYFMTWVRQA PGKGLEWVSS IVPSGGMTQY    60

ADSVKGRFTI SRDNSKNTLY LQMNSLRAED TAVYYCARDS YSSSWFDIWG QGTMVTVSSA   120

STKGPSVFPL APSSKS                                                   136

M8-G09              LC
QDIQMTQSPS SLSASVGDTV TITCRASQGV SYYLAWFQQK PGKAPKSLIY GASSLQSGVP    60

SKFSGSGSGT VFTLTISSLQ PDDFATYYCQ QYNTYPPTFG QGTRLDIK                108

M8-G09              HC
EVQLLESGGG LVQPGGSLRL SCAASGFTFS LYEMLWVRQA PGKGLEWVSV IYPSGGYTDY    60

ADSVKGRFTI SRDNSKNTLY LQMNSLRAED MAVYYCARSF SGFGEIDYWG QGTLVTVSSA   120

STKGPSVFPL APSSKS                                                   136

M8-H04              LC
QDIQMTQSPS SLSASIGDRV TITCRASQYI STYLNWYEQK PGKAPKLLIY GTSSLQSGVP    60

SRFSGSGSGT EFSLTISSLQ PEDFATYYCQ QSFTTPFTFG QGTKLEIK                108

M8-H04              HC
EVQLLESGGG LVQPGGSLRL SCAASGFTFS GYWMGWVRQA PGKGLEWVSS ISSSGGWTQY    60

ADSVKGRFTI SRDNSKNTLY LQMNSLRAED TATYYCARDD EIAAGGAFDI WGQGAMVTVS   120

SASTKGPSVF PLAPSSKS                                                 138

M9-A03              LC
QDIQMTQSPS SLSASLGDRV TITCRASQNI DIYLNWYQQT PGKAPKLLIY GAYNLQSGVP    60

SRFSGSGSGT DFTLTISSLQ PEDFGTYYCQ QSYGTPVFGQ GTKLEIK                 107
```

```
M9-A03                   HC
EVQLLESGGG LVQPGGSLRL SCAASGFTFS GYFMMWVRQA PGKGLEWVSS IYSSGGYTDY        60

ADSVKGRFTI SRDNSKNTLY LQMNSLRAED TAVYYCAREV AGTYAFDIWG QGTMVTVSSA       120

STKGPSVFPL APSSKS                                                      136

M9-A08                   LC
QDIQMTQSPS SLSASVGDRV TVTCRASQRI STYLNWYQQK PGKAPKLLIS GASSLQSGVP        60

SRFSGSGSGT DFTLTISSLQ PDDFATYYCQ QSYNTPRTFG QGTKVEIR                   108

M9-A08                   HC
EVQLLESGGG LVQPGGSLRL SCAASGFTFS AYEMWWVRQA PGKGLEWVSY IGSSGGSTSY        60

ADSVKGRFTI SRDNSKNTLY LQMNSLRAED TAVYYCTGGN SSSFDAFDIW GQGTMVTVSS       120

ASTKGPSVFP LAPSSKS                                                     137

M9-C08                   LC
QDIQMTQSPS SLSASVGDRV TITCRASQSI SIYVNWYQQK PGKAPNLLIF AASSLQRGVP        60

SRFSGSGSGA DFTLTISSLQ PEDFATYYCQ QSFSTPLTFG GGTKVEIK                   108

M9-C08                   HC
EVQLLESGGG LVQPGGSLRL SCAASGFTFS HYGMVWVRQA PGKGLEWVSY IVPSGGLTYY        60

ADSVKGRFTI SRDNSKNTLY LQMNSLRAED TAVYYCARVD YTGDLGYWG QGTLVTVSSA        120

STKGPSVFPL APSSKS                                                      136

M9-C10                   LC
QDIQMTQSPS SLSASVGDRV TITCRASQGI SSYLNWYQQK PGNAPNLLIY GASSLQSGVP        60

SRFSGSGSGT DFTLTISSLQ PEDFATYYCQ ESYSTLFTFG PGTTVEIK                   108

M9-C10                   HC
EVQLLESGGG LVQPGGSLRL SCAASGFTFS LYPMQWVRQA PGKGLEWVSS IGSSGGMTFY        60

ADSVKGRFTI SRDNSKNTLY LQMNSLRAED TAVYYCTREV GAAGFAFDIW GQGTMVTVSS      120

ASTKGPSVFP LAPSSKS                                                     137

M9-D08                   LC
QDIQMTQSPS SLSASVGDRV TLTCRASRTI SFYLNWYQQK AGKAPELLIY GGSSLHSGVP        60

SRFSGSGSGT DFSLTISNLQ PEDIAVYYCQ QSFSSPWTFG QGTKVEIK                   108

M9-D08                   HC
EVQLLESGGG LVQPGGSLRL SCAASGFTFS WYKMMWVRQA PGKGLEWVSS IYPSGGWTNY        60

ADSVKGRFTI SRDNSKNTLY LQMNSLRAED TAVYYCTRGS PWGDDAFDIW GQGTMVTVSS      120

ASTKGPSVFP LAPSSKS                                                     137

M9-E04                   LC
QDIQMIQSPS SLSASVGDRV TITCRASQSI SGYLNWYQQR SGKAPKLLIF AASNLQTGVP        60

SRFSGSGSGT DFTLTINNLQ PEDFATYYCQ QSHTPPKTFG PGTKVDIK                   108

M9-E04                   HC
EVQLLESGGG LVQPGGSLRL SCAASGFTFS EYDMMWVRQA PGKGLEWVSS IGSSGGMTYY        60

ADSVKGRFTI SRDNSKNTLY LQMNSLRAED TAVYYCARDQ VAAAAIDYWG QGTLVTVSSA      120

STKGPSVFPL APSSKS                                                      136

M9-F08                   LC
QDIQMTqSPS SLSASVGDRV TITCRASQSI SSYLNWYQQK PGKAPKLLIY AASSLQSGVP        60

SRFSGSGSGT DFTLTISSLQ PEDFATYYCQ QSYSTPPYTF GQGTKLEIK                  109

M9-F08                   HC
EVQLLESGGG LVQPGGSLRL SCAASGFTFS PYAMTWVRQA PGKGLEWVSV IYPSGGFTDY        60

ADSVKGRFTI SRDNSKNTLY LQMNSLRAED TAMYYCARAS GSYLDAFDIW GQGTMVTVSS      120

ASTKGPSVFP LAPSSKS                                                     137
```

```
M9-F09                   LC
QDIQMTQSPS SLSASVGDRV TITCRASQSI SSYLNWYQQK PGKAPKLLIY AASSLQSGVP     60

SKFSGSGSGT DYTLTISSLQ PEDFATYYCQ QTYTTPWTFG QGTKVEIK                 108

M9-F09                   HC
EVQLLESGGG LVQPGGSLRL SCAASGFTFS SYPMGWVRQA PGKGLEWVSR ISSSGGMTIY     60

ADSVKGRFTI SRDNSKNTLY LQMNSLRAED TAVYYCARDD WNVGMDVWGQ GTTVTVSSAS    120

TKGPSVFPLA PSSKS                                                    135

M9-F10                   LC
QDIQMTQSPS SLSASVGDRV TITCRASQSI NTYLNWYQQK PGKAPKVLIH AASTLESGVP     60

SRFSGSGSGT DFTLTISSLQ PEDFATYYCQ QSYSTPYTFG QGTKLEVR                 108

M9-F10                   HC
EVQLLESGGG LVQPGGSLRL SCAASGFTFS DYDMEWVRQA PGKGLEWVSS ISPSGGSTIY     60

ADSVKGRFTI SRDNSKNTLY LQMNSLRAED TAVYYCARQG LLTAFDIWGQ GTMVTVSSAS    120

TKGPSVFPLA PSSKS                                                    135

M9-G08                   LC
QDIQMTQSPS SLSASVGDRV TITCRASQSI SSYLNWYQQK PGKAPKLLIY AASSLQSGVP     60

SRFSGSGSGT DFTLTISSLQ PEDFATYYCQ QSYSTPITFG GGTKVEIK                 108

M9-G08                   HC
EVQLLESGGG LVQPGGSLRL SCAASGFTFS YYTMLWVRQA PGKGLEWVSS IYPSGGFTMY     60

ADSVKGRFTI SRDNSKNTLY LQMNSLRAED TAVYYCARVD TAMAMIDYWG QGTLVTVSSA    120

STKGPSVFPL APSSKS                                                   136

M9-H02                   LC
QDIQMTQSPS SLSASVGDRV IITCRASRSI ATYLNWYQQK PGKAPNLLIF GASTLQSGVP     60

SRFSGSGSGT DFTLTISDLQ PEDFATYYCQ QSFSDPYTFG QGTNLEMK                 108

M9-H02                   HC
EVQLLESGGG LVQPGGSLRL SCAASGFTFS AYMMIWVRQA PGKGLEWVSV IYPSGGVTMY     60

ADSVKGRFTI SRDNSKNTLY LQMNSLRAED TAVYYCARGT VGASDAFDIW GQGTMVTVSS    120

ASTKGPSVFP LAPSSKS                                                  137

M9-H03                   LC
QYELTQAPSV SVAPGQTASI TCSGDKLGNR YTSWYQQKPG QSPVLVIFQD NKRPSGIPER     60

FSGSNSGNTA TLTISGTQAM DEADYYCQAL DSNTYVFGTG TKVTVL                  106

M9-H03                   HC
EVQLLESGGG LVQPGGSLRL SCAASGFTFS WYSMGWVRQA PGKGLEWVSY IVPSGGYTMY     60

ADSVKGRFTI SRDNSKNTLY LQMNSLRAED TAVYYCARDP GVSYYYYGMD VWGQGTTVTV    120

SSASTKGPSV FPLAPSSKS                                                139

M9-H04                   LC
QDIQMTQSPS SLSASVGDRV TITCRASQSI SSYLNWYQQK PGKAPKLLIY AASSLQSGVP     60

SRFSGSGSGT DFTLTISSLQ PEDFATYYCQ QSYSTPPTFG QGTRLEIK                 108

M9-H04                   HC
EVQLLESGGG LVQPGGSLRL SCAASGFTFS AYTMWWVRQA PGKGLEWVSS IWPSGGSTFY     60

ADSVKGRFTI SRDNSKNTLY LQMNSLRAED TAVYYCARTY DSSAGEVDYW GQGTLVTVSS    120

ASTKGPSVFP LAPSSKS                                                  137

M10-A03                  LC
QDIQMTQSPS SLSASVGDRV TITCRASQRI SFYLNWFQQK PGKAPNLLIY GASSLQSGVP     60

SRFSGSGSGT DFTLTISSLQ PKDFGTYYCQ QTFSTPNTFG QGTKLEIK                 108
```

```
M10-A03                  HC
EVQLLESGGG LVQPGGSLRL SCAASGFTFS PYPMQWVRQA PGKGLEWVSS ISSSGGMTEY      60

ADSVKGRFTI SRDNSKNTLY LQMNSLRAED TAVYYCARDD YGGKGGAFDI WGQGTMVTVS     120

SASTKGPSVF PLAPSSKS                                                   138

M10-A12                  LC
QDIQMTQSPL SLSAFVGDRV TITCRASRDI SVYLNWYQLK SGKAPKLLIY GASSLQSGVP      60

SRFSGSGSGT DFTLTITSLQ PEDFATYYCQ QSYSIPFTFG GGTKVETK                 108

M10-A12                  HC
EVQLLESGGG LVQPGGSLRL SCAASGFTFS LYLMHWVRQA PGKGLEWVSS IYSSGGFTTY      60

ADSVKGRFTI SRDNSKNTLY LQMNSLRAED TAVYYCARDT DYGMDVWGQG TTVTVSSAST    120

KGPSVFPLAP SSKS                                                      134

M10-B09                  LC
QDIQMTQSPS SLSASVGDGV TITCRASQSI STYLNWYQQR PGKAPKLLIY GASSLQSGVP      60

SRFSGSGSGT DFTLTISSLQ REDFATYYCQ QSFSTPWTFG QGTRVEIK                 108

M10-B09                  HC
EVQLLESGGG LVQPGGSLRL SCAASGFTFS WYEMSWVRQA PGKGLEWVSR IWPSGGVTMY      60

ADSVKGRFTI SRDNSKNTLY LqMNSLRAED TAVYYCTRTS ITTVGMDVWG QGTTVTVSSA    120

STKGPSVFPL APSSKS                                                    136

M10-C11                  LC
QDIQMTQSPS SLSASVGDRV TITCRASQSI SIYLNWYQQK PEKAPKLLIF AASTLQSGVP      60

SRFSGSGSGT DFTLTISNLQ PEDFATYYCQ QSHSIPPTFG LGTKVEVK                 108

M10-C11                  HC
EVQLLESGGG LVQPGGSLRL SCAASGFTFS MYPMMWVRQA PGKGLEWVSY ISPSGGMTDY      60

ADSVKGRFTI SRDNSKNTLY LQMNSLRAED MAVYYCARVA GSSDAFDIWG QGTMVTVSSA    120

STKGPSVFPL APSSKS                                                    136

M10-D11                  LC
QDIQMTQSPL SLPVTPGEPA SISCRSSQSL LHSNGYNYLD WYLQKPGQSP QLLIYLGSNR      60

ASGVPDRFSG SGSGTDFTLK ISRVEAEDVG VYYCMQALQT PLTFGPGTKV HIK           113

M10-D11                  HC
EVQLLESGGG LVQPGGSLRL SCAASGFTFS AYPMNWVRQA PGKGLEWVSR ISSSGGNTSY      60

ADSVKGRFTI SRDNSKNTLY LQMNSLRAED TAVYYCALGY LGYWGQGTLV TVSSASTKGP    120

SVFPLAPSSK S                                                         131

M10-E06                  LC
QDIQMTQSPS SLSASVGDRV TITCRASQSI STYLNWYQQK PGKAPKLLIY GASSLQSGVP      60

SRFSGSGSGT DFTLTISSLQ PEDFTIYYCQ QSYSDPYTFG QGTKLDIK                 108

M10-E06                  HC
EVQLLESGGG LVQPGGSLRL SCAASGFTFS LYRMFWVRQA PGKGLEWVSS IWSSGGPTMY      60

ADSVKGRFTI SRDNSKNTLY LQMNSLRAED TAVYYCAREY PSTYYFDYWG QGTLVTVSSA    120

STKGPSVFPL APSSKS                                                    136

M10-F09                  LC
QDIQMTQSPS SLSASVGDRV TITCRASQTI DDDLIWYQQK PGRAPKLLIY AASSLQSGVP      60

SRFSGSGSGT DFTLTITSLQ PEDFATYYCQ QSYNIPRTFG QGTKLESK                 108

M10-F09                  HC
EVQLLESGGG LVQPGGSLRL SCAASGFTFS NYDMMWVRQA PGKGLEWVSY ISPSGGFTRY      60

ADSVKGRFTI SRDNSKNTLY LQMNSLRAED TATYYCAKDI YYYNWGPSHY FDSWGQGTLV    120

TVSSASTKGP SVFPLAPSSK S                                              141
```

```
M10-G09                 LC
QDIQMTQSPS SLSASVGDSV TITCRASQSI SGYINWYQQK AGKAPKLLIY AASSLQSGVP        60

SRFSGSGSGT HFTLTISSLQ PEDFATYYCQ QYVSYPFTFG PGTKVDIK                   108

M10-G09                 HC
EVQLLESGGG LVQPGGSLRL SCAASGFTFS QYGMQWVRQA PGKGLEWVSS IRSSGGATRY        60

ADSVKGRFTI SRDNSKNTLY LQMNSLRAED TAVYYCARDG YYDSSGYPDY WGQGTLVTVS       120

SASTKGPSVF PLAPSSKS                                                    138

M11-A10                 LC
QDIQMTQSPS SLSASVGDRV AITCRASQSI DTYLNWYQQK PGKAPKLLIY DASNLEIGVP        60

SRFSGSGSGT DFTFIINSLQ PEDVATYYCQ HYLYAPYSFG QGTKLEIK                   108

M11-A10                 HC
EVQLLESGGG LVQPGGSLRL SCAASGFTFS NYWMMWVRQA PGKGLEWVSG IGSSGGFTSY        60

ADSVKGRFTI SRDNSKNTLY LQMNSLRAED TAVYYCAKGS YSDYGVFESW GQGTLVTVSS       120

ASTKGPSVFP LAPSSKS                                                     137

M11-E01                 LC
QDIQMTQSPS SLSASVGDRV TITCRASQSI SSYLNWYQQK PGKAPKLLIY AASSLQSGVP        60

SRFSGSGSGT DFTLTISSLQ PEDFATYYCQ QSYSTPPTFG QGTKVEIK                   108

M11-E01                 HC
EVQLLESGGG LVQPGGSLRL SCAASGFTFS TYEMYWVRQA PGKGLEWVSG IGSSGGMTMY        60

ADSVKGRFTI SRDNSKNTLY LQMNSLRAED TAMYYCAREQ PGIAALQFWG QGTLVTVSSA       120

STKGPSVFPL APSSKS                                                      136

M11-E04                 LC
QDIQMTQSPS SLSASVGDRV TITCRASQSI SIYLTWYQHR PGKAPNLLIY GAATLQTGVP        60

SRFSGSGSGT DFTLTIRGLQ PEDFATYYCQ QTFSLPRTFG QGTKLEIK                   108

M11-E04                 HC
EVQLLESGGG LVQPGGSLRL SCAASGFTFS MYHMNWVRQA PGKGLEWVSG IVSSGGVTFY        60

ADSVKGRFTI SRDNSKNTLY LQMNSLRAED TAVYYCARIT TVTTGGAFDI WGQGTMVTVS       120

SASTKGPSVF PLAPSSKS                                                    138

M11-E05                 LC
QDIQMTQSPS SLSASVGDTV TITCRTSQTI NNYLNWYQQR PGEAPKVLIY ATHTLESGVP        60

SRFSGSGSGT DFTLTIGSLQ PEDFATYYCQ QSFAFPYTFG QGTKVEIT                   108

M11-E05                 HC
EVQLLESGGG LVQPGGSLRL SCAASGFTFS WYTMGWVRQA PGKGLEWVSW IYFGGLTTYA        60

DSVKGRFTIS RDNSKNTLYL QMNSLRAEDT AVYYCARLGG PLDAFDIWGQ GTMVTVSSAS       120

TKGPSVFPLA PSSKS                                                       135

M11-E06                 LC
QDIQMTQSPS SLSASIGDRV TISCRASRGI GTYLNWYQQH AGKAPKLLIR AASSLETGVP        60

PRFSGSGSGT DFTLTISSLQ SDDFATYYCQ ESFTNVYNFG QGTKLEIK                   108

M11-E06                 HC
EVQLLESGGG LVQPGGSLRL SCAASGFTFS QYAMHWVRQA PGKGLEWVSS IYPSGGFTLY        60

ADSVKGRFTI SRDNSKNTLY LQMNSLRAED TAMYYCARGG WLAGGELLNW GQGTLVTVSS       120

ASTKGPSVFP LAPSSKS                                                     137

M11-G09                 LC
QDIQMTQSPS SLSASVGDRV TITCRTSQGI NHYLNWYQQK PGKAPKILVF AASELQTGVP        60

SRFSGTGSGT SYTLTITSLQ PEDVATYYCQ QTYTSPYTFG QGTKLEVK                   108
```

```
M11-G09                  HC
EVQLLESGGG LVQPGGSLRL SCAASGFTFS LYNMTWVRQA PGKGLEWVSY IYPSGGGTHY      60

ADSVKGRFTI SRDNSKNTLY LQMNSLRAED TAVYYCARDT GFWSADAFDI WGQGTMVTVS     120

SASTKGPSVF PLAPSSKS                                                   138

M11-G12                  LC
QDIQMTQSPS SLSAFVGDRV SITCRASQTI SVYVNWYQHK SGQAPKLLIY GASSLQSGVP      60

SRFSGSGSGT DFTLTISSLQ PEDFATYFCQ QSYSIPFTFG GGTDVQIR                 108

M11-G12                  HC
EVQLLESGGG LVQPGGSLRL SCAASGFTFS QYPMNWVRQA PGKGLEWVSS ISSSGGFTTY      60

ADSVKGRFTI SRDNSKNTLY LQMNSLRAED TAVYYCAREE QQGGFDYWGQ GTLVTVSSAS     120

TKGPSVFPLA PSSKS                                                     135

M12-A08                  LC
QDIQMTQSPS SLSASVGDRV TITCRASQSI SRYLNWYQQK PGKAPKLLIY AASTLETGVP      60

SRFSGSGSGT DFTLTITTLQ PEDFVIYYCQ QSYSTPYTFG QGTKLEIK                 108

M12-A08                  HC
EVQLLESGGG LVQPGGSLRL SCAASGFTFS WYYMGWVRQA PGKGLEWVSW IVSSGGLTLY      60

ADSVKGRFTI SRDNSKNTLY LQMNSLRAED TAMYYCARTT VTTGDAFDIW GQGTMVTVSS     120

ASTKGPSVFP LAPSSKS                                                   137

M12-B04                  LC
QDIQMTQSPS SLSASVGDRV TITCRASQGI RNDLGWYQHK PGKAPKLLIY AASILQSGVP      60

SRFSGTASGT DFTLTISSLQ PEDFATYFCL QDYEYPLTFG GGTKLDIK                 108

M12-B04                  HC
EVQLLESGGG LVQPGGSLRL SCAASGFTFS LYSMYWVRQA PGKGLEWVSR IRPSGGGTVY      60

ADSVKGRFTI SRDNSKNTLY LQMNSLRAED TAVYYCARDP LYSSGDVWGQ GTTVTVSSAS     120

TKGPSVFPLA PSSKS                                                     135

M12-C09                  LC
QDIQMTQSPS SLSASVGDRV TITCRASQSI GIYLNWYHQK PGKAPNLLIY GASSLQSGVP      60

SRFSGSGSGT DFTLTISSLQ PGDFATYYCQ HSYSTPFTFG GGTKVEIK                 108

M12-C09                  HC
EVQLLESGGG LVQPGGSLRL SCAASGFTFS SYAMVWVRQA PGKGLEWVSS IGSSGGFTLY      60

ADSVKGRFTI SRDNSKNTLY LQMNSLRAED TAVYYCASMN LGGGDAFDIW GQGTMVTVSS     120

ASTKGPSVFP LAPSSKS                                                   137

M12-C10                  LC
QSALTQPPSV SVSPGQTASI TCSGDKLGEK YVSWYQQKPG QSPVVIYQD NKRPSGIPER       60

FSGSNSGNTA TLTISGTQAV DEADYYCQAW DSYTVVFGGG SKLTVLGQPK               110

M12-C10                  HC
EVQLLESGGG LVQPGGSLRL SCAASGFTFS DYEMHWVRQA PGKGLEWVSG ISPSGGKTQY      60

ADSVKGRFTI SRDNSKNTLY LQMNSLRAED TAVYYCARDL KWGGRGSPDW YFDLWGRGTL    120

VTVSSASTKG PSVFPLAPSS KS                                             142

M12-D10                  LC
QDIQMTQSPS SLSASVGDRV TITCRASQSI SSYLNWYQQK PGKAPKLLIY AASSLQSGVP      60

SRFSGSGSGT DFTLTISSLQ PEDFATYYCQ QSYSTPPTFG GGTKVEIK                 108

M12-D10                  HC
EVQLLESGGG LVQPGGSLRL SCAASGFTFS NYPMDWVRQA PGKGLEWVSS ISSSGGWTNY      60

ADSVKGRFTI SRDNSKNTLY LQMNSLRAED TAVYYCATDT SGSYLGFDYW GQGTLVTVSS    120

ASTKGPSVFP LAPSSKS                                                   137
```

-continued

```
M12-E06                 LC
QDIQMTQSPS SLSASVGDRV SITCRASQSI STYLNWYQHK PGKAPTLLIY GAFSLQSGVP    60

SRFSGSGSGT DFALTISSLQ PEDFATYYCQ QSHSTPPTFG QGTRVEIK                108

M12-E06                 HC
EVQLLESGGG LVQPGGSLRL SCAASGFTFS QYKMLWVRQA PGKGLEWVSG IGPSGGLTAY    60

ADSVKGRFTI SRDNSKNTLY LQMNSLRAED TAVYYCARAP WFGELGMDVW GQGTTVTVSS   120

ASTKGPSVFP LAPSSKS                                                  137

M27-A10                 LC
QDIQMTQSPS SLSASVGDRV TITCRASQSI SAYLNWYQQK PGKAPQLLMY GVGSLQSGVP    60

SRFSGSGSGT DFTLTISSLQ PEDFATYFCQ QGYTTPVTFG GGTKVEIK                108

M27-A10                 HC
EVQLLESGGG LVQPGGSLRL SCAASGFTFS WYRMDWVRQA PGKGLEWVSS IWPSGGLTSY    60

ADSVKGRFTI SRDNSKNTLY LQMNSLRAED TAVYYCARGW APGGDAFDIW GQGTMVTVSS   120

ASTKGPSVFP LAPSSKS                                                  137

M27-B01                 LC
QDIQMTQSPS SLSASVGDRV TITCRASQSI SSYLNWYQQK PGKAPKLLIY AASSLQSGVP    60

SRFSGSGSGT DFTLTISSLQ PEDFATYYCQ QSYSTPYTFG QGTKLEIK                108

M27-B01                 HC
EVQLLESGGG LVQPGGSLRL SCAASGFTFS DYTMWWVRQA PGKGLEWVSS ISSSGGITFY    60

ADSVKGRFTI SRDNSKNTLY LQMNSLRAED TAVYYCARSA DTAMGGAFDI WGQGTMVTVS   120

SASTKGPSVF PLAPSSKS                                                 138

M27-B12                 LC
QYELTQPPAV SVSPGQTATI TCSGDKLGDE YAAWYQQKPG QSPVLVIYQD RKRPSGIPER    60

FSGSNFGNTA TLTITGTQVM DEADYYCQAW GKRNVVFGGG TKLTVL                  106

M27-B12                 HC
EVQLLESGGG LVQPGGSLRL SCAASGFTFS WYQMMWVRQA PGKGLEWVSS ISPSGGITEY    60

ADSVKGRFTI SRDNSKNTLY LQMNSLRAED TAVYYCARDR SSGWYYYGMD VWGQGTTVTV   120

SSASTKGPSV FPLAPSSKS                                                139

M27-E03                 LC
QDIQMTQSPS SLSASVGDRV TITCRASQSI SSYLNWYQQK PGKAPKLLIY AASSLQSGVP    60

SRFSGSGSGT DFTLTISSLQ PEDFATYYCQ QSYSTPRTFG QGTKVEIK                108

M27-E03                 HC
EVQLLESGGG LVQPGGSLRL SCAASGFTFS SYMMHWVRQA PGKGLEWVSG IYPSGGWTDY    60

ADSVKGRFTI SRDNSKNTLY LQMNSLRAED TATYYCARLV AGLDAFDIWG QGTMVTVSSA   120

STKGPSVFPL APSSKS                                                   136

M27-F04                 LC
QDIQMTQSPS SLSASVGDRV TITCRASQSI SSYLNWYQQK PGKAPKLLIY AASSLQSGVP    60

SRFSGSGSGT DFTLTISSLQ PEDFATYYCQ QSYSTPPTFG QGTKVEIK                108

M27-F04                 HC
EVQLLESGGG LVQPGGSLRL SCAASGFTFS WYPMTWVRQA PGKGLEWVSS IGPSGGQTIY    60

ADSVKGRFTI SRDNSKNTLY LQMNSLRAED TAVYYCTTEY GDYGGGFDPW GQGTLVTVSS   120

ASTKGPSVFP LAPSSKS                                                  137

M27-F11                 LC
QDIQMTQSPS FLSASVGDRV TITCRASQGI SSYLAWYQQK PGKAPKLLIY AASSLQSGVP    60

SRFSGSGSGT DFTLTISSLQ PEDFATYYCQ QSYNTLRTFG PGTKVDLK                108
```

-continued

```
M27-F11              HC
EVQLLESGGG LVQPGGSLRL SCAASGFTFS SYHMMWVRQA PGKGLEWVSS IYPSGGATMY      60

ADSVKGRFTI SRDNSKNTLY LQMNSLRAED TAMYYCARDG YHYGDYTYFQ HWGQGTLVTV     120

SSASTKGPSV FPLAPSSKS                                                  139

M27-G01              LC
QDIQMTQSPS SLSASVGDRV TITCRASQSI STYLNWYQQK PGKAPKLLIY GASSLQSGVP      60

SRFSGSGSGT DFTLTISSLQ PEDFTIYYCQ QSYSDPYTFG QGTKLDIK                  108

M27-G01              HC
EVQLLESGGG LVQPGGSLRL SCAASGFTFS LYRMFWVRQA PGKGLEWVSS IWSSGGPTMY      60

ADSVKGRFTI SRDNSKNTLY LQMNSLRAED TAVYYCAREY PSTYYFDYWG QGTLVTVSSA    120

STKGPSVFPL APSSKS                                                    136

M27-G04              LC
QDIQMTQSPS SLSASVGDRV TITCRASQRI SYYLTWYQQK PGKVPKLLIY AASSLESGVP      60

SRFSGSGSGT DFTLTISNLQ PEDFATYYCQ QAFSTPFTFG GGTKVEIK                 108

M27-G04              HC
EVQLLESGGG LVQPGGSLRL SCAASGFTFS AYYMVWVRQA PGKGLEWVSY ISPSGGQTQY      60

ADSVKGRFTI SRDNSKNTLY LQMNSLRAED TAVYYCAREA ISSSSFDYWG QGTLVTVSSA    120

STKGPSVFPL APSSKS                                                    136

M27-G09              LC
QDIQMTQSPS SVSASVGDRI TITCRTRQSI SNYLNWYQQK PGEPPKLLIF AASSLQSGVP      60

SRFSGSGTGT EFTLTISSLQ PEDLAIYYCQ QSYDIPFTFG QGTKLEIK                 108

M27-G09              HC
EVQLLESGGG LVQPGGSLRL SCAASGFTFS EYDMAWVRQA PGKGLEWVSY IVSSGGFTSY      60

ADSVKGRFTI SRDNSKNTLY LQMNSLRAED TAVYYCTTWA GWIAAADYWG QGTLVTVSSA    120

STKGPSVFPL APSSKS                                                    136

M27-H10              LC
QDIQMTQSPS SLSASVGDRV TITCRASQSI SNYLNWYQQK PGKAPKFLIY AASSLQSGVP      60

SRFSGSGSGT DFTLSISSLQ PEDFATYYCQ QSYSTPQTFG QGTKVEMK                 108

M27-H10              HC
EVQLLESGGG LVQPGGSLRL SCAASGFTFS AYQMAWVRQA PGKGLEWVSV IYSSGGYTDY      60

ADSVKGRFTI SRDNSKNTLY LQMNSLRAED TAVYYCARHN WNDGAFDIWG QGTMVTVSSA    120

STKGPSVFPL APSSKS                                                    136

M28-A01              LC
QDIQMTQSPS SLSASVGDRV TITCRASQSI SSYLNWYQQK PGKAPKLLIY AASSLQSGVP      60

SRFSGSGSGT DFTLTISSLQ PEDFATYYCQ QSYSTLTFGG GTKVEIK                  107

M28-A01              HC
EVQLLESGGG LVQPGGSLRL SCAASGFTFS WYAMHWVRQA PGKGLEWVSG IYSSGGYTKY      60

ADSVKGRFTI SRDNSKNTLY LQMNSLRAED TAVYYCARDL SNGDDVFDIW GQGTMVTVSS    120

ASTKGPSVFP LAPSSKS                                                   137

M28-C03              LC
QDIQMTQSPS SLSASVGDRV TITCRASQSI NFYLNWYQQK PGKAPKLLIY VASSLESGVP      60

SRFSGSASGT EFTLTISSLQ PEDFATYYCL QSYSAPYTFG QGTKVEIT                 108

M28-C03              HC
EVQLLESGGG LVQPGGSLRL SCAASGFTFS YYQMGWVRQA PGKGLEWVSS IYPSGGMTDY      60

ADSVKGRFTI SRDNSKNTLY LQMNSLRAED TAVYYCTRGS PWGDDAFDIW GQGTMVTVSS    120

ASTKGPSVFP LAPSSKS                                                   137
```

-continued

```
M28-D02            LC
QDIqMTQSPS SLSASEGDMV TITCRTSRRI GTYLNWYQQK PGKAPKLLIY GASSLQSGVP      60

SRFSGSGSGT DFTLTVSSLQ PEDVGTYYCQ QSFSSPWTFG PGTKVEIK                  108

M28-D02            HC
EVQLLESGGG LVQPGGSLRL SCAASGFTFS WYPMQWVRQA PGKGLEWVSY IYPSGGGTDY      60

ADSVKGRFTI SRDNSKNTLY LQMNSLRAED TATYYCATSS GWLGDAFDIW GQGTMVTVSS     120

ASTKGPSVFP LAPSSKS                                                   137

M28-D12            LC
QDIQMTQSPS SLSASVGDRV TITCRASQSI ATYLNWYQQK PGRAPKLLIY AASSLQSGVP      60

SRFVGGGSGS GTHFTLTISS LQPEDFATYY CQQSYSTRET FGQGTKVEIK                110

M28-D12            HC
EVQLLESGGG LVQPGGSLRL SCAASGFTFS WYTMHWVRQA PGKGLEWVSV IYPSGGPTSY      60

ADSVKGRFTI SRDNSKNTLY LQMNSLRAED TATYYCARDG SGSYLGFDYW GQGTLVTVSS     120

ASTKGPSVFP LAPSSKS                                                   137

M28-E01            LC
QDIQMTQSPS SLSASVGDRV TITCRASQSI SSYLNWYQQK PGKAPKLLIY AASSLQSGVP      60

SKFSGSGSGT DYTLTISSLQ PEDFATYYCQ QTYTTPWTFG QGTKVEIK                  108

M28-E01            HC
EVQLLESGGG LVQPGGSLRL SCAASGFTFS SYPMGWVRQA PGKGLEWVSR ISSSGGMTIY      60

ADSVKGRFTI SRDNSKNTLY LQMNSLRAED TAVYYCARDD WNVGMDVWGQ GTTVTVSSAS     120

TKGPSVFPLA PSSKS                                                     135

M28-E11            LC
QDIQMTQSPS SVSASVGDRV TINCRASQDI SNWLAWYQQK PGKAPNLLIY AASSLQTGAP      60

SRFSGSGSGT DFTLTISSLQ PEDFGTYVCQ QSYSLPWTFG LGTKVEVR                  108

M28-E11            HC
EVQLLESGGG LVQPGGSLRL SCAASGFTFS LYDMTWVRQA PGKGLEWVSG ISSSGGVTIY      60

ADSVKGRFTI SRDNSKNTLY LQMNSLRAED TAVYYCARTY YYDSSGYADA FDIWGQGTMV    120

TVSSASTKGP SVFPLAPSSK S                                              141

M28-F01            LC
QDIQMTQSPS SLSASVGDRV TITCRASQSI NTYLNWYQQK PGKAPKVLIH AASTLESGVP      60

SRFSGSGSGT DFTLTISSLQ PEDFATYYCQ QSYSTPPTFG QGTKVEIK                  108

M28-F01            HC
EVQLLESGGG LVQPGGSLRL SCAASGFTFS VYLMHWVRQA PGKGLEWVSG ISPSGGYTQY      60

ADSVKGRFTI SRDNSKNTLY LQMNSLRAED TAVYYCARPG GLDAFDIWGQ GTMVTVSSAS     120

TKGPSVFPLA PSSKS                                                     135

M28-F05            LC
QDIQMTQSPS SLSASVGDRV TITCRASQSI SSYLNWYQQK PGKAPKLLIY AASSLQSGVP      60

SRFSGSGSGT DFTLTISSLQ PEDFATYYCQ QSYSTPLTFG GGTKVEIK                  108

M28-F05            HC
EVQLLESGGG LVQPGGSLRL SCAASGFTFS RYIMWWVRQA PGKGLEWVSG IYSSGGYTQY      60

ADSVKGRFTI SRDNSKNTLY LQMNSLRAED TAMYYCAREL EGLGGFDYWG QGTLVTVSSA    120

STKGPSVFPL APSSKS                                                    136

M28-F07            LC
QDIQMTQSPS SVSASVGDRV TITCRASQGI SSWLAWYQQK PGKAPKLLIY ATSGLQSGVP      60

SRFSGSGSGT DFTLTISSLQ PEDFATYYCQ QAKSFPLTFG GGTRVEIK                  108
```

-continued

```
M28-F07                   HC
EVQLLESGGG LVQPGGSLRL SCAASGFTFS DYTMYWVRQA PGKGLEWVSS IVPSGGHTLY        60

ADSVKGRFTI SRDNSKNTLY LQMNSLRAED TAVYYCAKDH LSSWYGGFFD YWGQGTLVTV       120

SSASTKGPSV FPLAPSSKS                                                    139

M29-C07                   LC
QDIQMTQSPS SLSASVGDRV TITCRASQSI SSYLNWYQQK PGKAPKLLIY AASSLQSGVP        60

SRFSGSGSGT DFTLTISSLQ PEDFATYYCQ QSYSTRYTFG QGTKLEIK                    108

M29-C07                   HC
EVQLLESGGG LVQPGGSLRL SCAASGFTFS GYDMMWVRQA PGKGLEWVSV ISSSGGNTAY        60

ADSVKGRFTI SRDNSKNTLY LQMNSLRAED TAVYYCARES SGLYYFDYWG QGTLVTVSSA       120

STKGPSVFPL APSSKS                                                       136

M29-D10                   LC
QDIQMTQSPS SLSASVGDTV SITCRASQSI TIYLNWYQHK PGKAPNLLIY GASNLHSGVP        60

SRFSGSGSGT DFTLTISSLQ PEDFATYYCQ QSYDTPLTFG GGTKVEIK                    108

M29-D10                   HC
EVQLLESGGG LVQPGGSLRL SCAASGFTFS WYPMYWVRQA PGKGLEWVSS IGSSGGPTPY        60

ADSVKGRFTI SRDNSKNTLY LQMNSLRAED TAVYYCARWA DYGGSLDYWG QGTLVTVSSA       120

STKGPSVFPL APSSKS                                                       136

M29-E02                   LC
QSVLTQPPSV SEAPRQRVTI SCSGSSSNIG NNAVSWYQQL PGKAPKLLIY YDDLLPSGVS        60

DRFSGSKSGT SASLAISGLR SEDEADYYCA AWDDSLNGFV FGTGTKVTVL                  110

M29-E02                   HC
EVQLLESGGG LVQPGGSLRL SCAASGFTFS RYPMMWVRQA PGKGLEWVSV IYPSGGDTFY        60

ADSVKGRFTI SRDNSKNTLY LQMNSLRAED TAVYYCASGD DYLWEAAVYW GQGTLVTVSS       120

ASTKGPSVFP LAPSSKS                                                      137

M29-G08                   LC
QDIQMTQSPA TLSASPGETV TLSCRASQNI GNDVAWYRQR PGQAPRLLIH HASTRAYGIP        60

ARLRGSGSAT EFTLTITSLE PEDFAIYYCQ QFYDWPAHTF ALGTRLEIKR                  110

M29-G08                   HC
EVQLLESGGG LVQPGGSLRL SCAASGFTFS YYHMWVRQA PGKGLEWVSG ISPSGGFTFY         60

ADSVKGRFTI SRDNSKNTLY LQMNSLRAED TAVYYCARDY YYDSSGYSPL GYWGQGTLVT       120

VSSASTKGPS VFPLAPSSKS                                                   140

M29-G10                   LC
QDIQMTQSPS SLSSSVGDSA TITCRASQSI SIYLNWYQQK PGKAPKILIY GASQLESGVP        60

SRFSGSGSGT DFTLTVSGLQ PEDFATYWCQ QSYNVPYTFG QGTKLEIK                    108

M29-G10                   HC
EVQLLESGGG LVQPGGSLRL SCAASGFTFS FYKMIWVRQA PGKGLEWVSS ISSSGGSTQY        60

ADSVKGRFTI SRDNSKNTLY LQMNSLRAED TAVYYCARDR VDLGYLDYWG QGTLVTVSSA       120

STKGPSVFPL APSSKS                                                       136

M74-A07                   LC
QDIQMTQSPS SLSASVRDRV TITCRTSQNI NTYLNWYYQA PGRAPKLLIF GVSSLHRGVS        60

SRFSGSGDGT EFTLTISSLQ PEDIGTYFCQ QSYSSPWTFG QGTKVEIK                    108

M74-A07                   HC
EVQLLESGGG LVQPGGSLRL SCAASGFTFS QYLMMWVRQA PGKGLEWVSS IYPSGGYTSY        60

ADSVKGRFTI SRDNSKNTLY LQMNSLRAED TAVYYCARVS TAVADNDYWG QGTLVTVSSA       120

STKGPSVFPL APSSKS                                                       136
```

```
M76-F02                 LC
QDIQMTQSPS SLSASVGDRV TITCRASQTI DNYLHWYQQK PGKAPKVLIH DASSLQSGVP      60

PRFSGSGSGT DFTLTISSLQ PEDFATYYCQ QSYDTPQYTF GQGTKLEIK                 109

M76-F02                 HC
EVQLLESGGG LVQPGGSLRL SCAASGFTFS LYDMNWVRQA PGKGLEWVSG ISPSGGQTMY      60

ADSVKGRFTI SRDNSKNTLY LQMNSLRAED TAVYYCARQP MISAFDIWGQ GTMVTVSSAS     120

TKGPSVFPLA PSSKS                                                     135

M76-G02                 LC
QDIQMTQSPS SLSASVGDRV TITCRASQSI SSYLNWYQQK PGKAPKLLIY AASSLQSGVP      60

SRFSGSGSGT DFTLTISSLQ PEDFATYYCQ QSYSTPPWTF GQGTKVEIK                 109

M76-G02                 HC
EVQLLESGGG LVQPGGSLRL SCAASGFTFS LYAMWWVRQA PGKGLEWVSY ISSSGGFTSY      60

ADSVKGRFTI SRDNSKNTLY LQMNSLRAED TAVYYCARYR VGVAATDYWG QGTLVTVSSA     120

STKGPSVFPL APSSKS                                                    136

M76-G06                 LC
QDIQMTQSPS SLSASVRDRV TITCRASQSI STYLNWYQQK PGEAPKLLVF AASSLQSGVP      60

SRFSGSGSGT DFTLSISSLQ PEDFATYYCQ QSYSTPHTFG QGAKVEIK                  108

M76-G06                 HC
EVQLLESGGG LVQPGGSLRL SCAASGFTFS GYIMHWVRQA PGKGLEWVSW IYPSGGWTEY      60

ADSVKGRFTI SRDNSKNTLY LQMNSLRAED TAVYYCARDA PGVGAIDYWG QGTLVTVSSA     120

STKGPSVFPL APSSKS                                                    136

M76-H02                 LC
QDIQMTQSPS SLSASEGDRV TITCRASQDI SVYLNWYQMK SGKAPKLLIY GGASLQSGVP      60

ARFSGSGYGT DFTLTITDLR PEDFATYYCQ QSYSLPFTFG GGTKVEIK                  108

M76-H02                 HC
EVQLLESGGG LVQPGGSLRL SCAASGFTFS MYWMQWVRQA PGKGLEWVSY IYPSGGPTKY      60

ADSVKGRFTI SRDNSKNTLY LQMNSLRAED TAVYYCARPS GSYGDAFDIW GQGTMVTVSS     120

ASTKGPSVFP LAPSSKS                                                   137

M77-C07                 LC
QDIQMTQSPS TLSASVGDRV TITCRASQNI SSYLNWYQQK PGKAPKLLIY AASSLQSGVP      60

SRFSGSGSGT DFTLTISSLQ PEDFATYSCQ QSYSTPRTFG QGTKVEIK                  108

M77-C07                 HC
EVQLLESGGG LVQPGGSLRL SCAASGFTFS LYIMGWVRQA PGKGLEWVSG IYPSGGFTMY      60

ADSVKGRFTI SRDNSKNTLY LQMNSLRAED TAVYYCARES SGVAAPDYWG QGTLVTVSSA     120

STKGPSVFPL APSSKS                                                    136

M77-H04                 LC
QDIQMTQSPL SLPVTPGEPA SISCRSSQSL LHSRGYNYLD WYLQKPGQSP QLLIYLGSNR      60

ASGVPDRFSG SGSGTDFTLK ISRVEAEDVG VYYCMQALQR RTFGQGTKLE IK             112

M77-H04                 HC
EVQLLESGGG LVQPGGSLRL SCAASGFTFS YYTMIWVRQA PGKGLEWVSG IRSSGGGTRY      60

ADSVKGRFTI SRDNSKNTLY LQMNSLRAED TAVYYCAKDG SRYSYGSIYY YYGMDAWGQG     120

TTVTVSSAST KGPSVFPLAP SSKS                                           144
```

Example 2

Lead Antibody Inhibitors

Antibodies were selected as lead plasma kallikrein inhibitors on the basis of apparent inhibition constant ($K_{i,app}$), specificity with respect to lack of inhibition of other serine proteases, inhibition of bradykinin generation, and lack of binding to plasma prekallikrein (Table 3). Plasma kallikrein circulates in the plasma as an inactive zymogen (prekallikrein) at a concentration of approximately 500 nM. Antibodies that bound prekallikrein may be rendered inaccessible towards active plasma kallikrein inhibition and could substantially increase the in vivo dose required for efficacy.

Therefore, a surface plasmon resonance (SPR) assay was used to identify antibodies that do not bind prekallikrein (data not shown). Specifically, human IgGs (X81-B01, M162-A04 (R84-H05); M160-G12 (R84-D02); and M142-H08) were captured on a CM5 chip using an anti-human Fc surface and 100 nM of plasma kallikrein or 100 nM or 500 nM prekallikrein. The prekallikrein was treated with aprotinin-sepharose to remove active plasma kallikrein. The prekallikrein used for X81-B01 was buffer exchanged into the exact preparation of SPR running buffer (HEPES buffered saline) to avoid the refractive index shift that was observed with three other antibodies that were tested: M162-A04 (R84-H05); M160-G12 (R84-D02); and M142-H08.

Of the antibodies listed in Table 3, only M142-H08 inhibits human plasma kallikrein with a subnanomolar $K_{i,app}$. However, when M142-H08 was produced as an IgG it was found to be cleaved in the CDR3 of the heavy chain. Consequently, we decided to undertake two approaches to improve the affinity: 1) affinity maturation of M162-A04 and M160-G12 using a novel form of light chain shuffling called ROLIC (Rapid Optimization of Light Chains) (see, e.g., WO 2009/102927 and U.S. 2009-0215119); and 2) sequence optimization of M142-H08 in order to prevent the cleavage of the IgG that occurs while retaining the binding and inhibitor properties of M142-H08.

TABLE 3

Top Ranking Antibody Inhibitors of PKal Before Affinity Maturation or Sequence Optimization

| Criteria | M162-A04 | M160-G12 | M142-H08[a] |
|---|---|---|---|
| $K_{i,app}$ human pKal | 2 nM (as an IgG) | 5.6 nM (as an IgG) | 0.6 nM (as a Fab) |
| $K_{i,app}$ rodent pKal | 2 nM (mouse and rat) | <1 nM (mouse) | ~1 nM (mouse and rat) |
| Binds prekallikrein? | No | No | No |
| Specific inhibitor with respect to fXIa, plasmin, and trypsin | Yes | Yes | Yes |
| Inhibits bradykinin generation | Yes | Yes | Yes |

[a]When M142-H08 was produced as an IgG it was determined to be cleaved in the CDR3 of its heavy chain (GGLLLWFR-ELKSNYFDY).

Example 3

Sequence Optimization of M142-H08

Of the antibodies listed in Table 3, only M142-H08 inhibits human pKal with a subnanomolar $K_{i,app}$. However, when M142-H08 was produced as an IgG it was found to be cleaved in the CDR3 of the heavy chain. M142-H08 was found by mass spectrometry to be cleaved after the arginine in the "WFR" sequence of the HC-CDR3 sequence (GGLLLW-FRELKSNYFDY (SEQ ID NO: 899)). This cleavage suggests that a protease from the cells used to express the antibody (both CHO and 293T human kidney cells) is enzymatically cleaving the antibody at a single specific site. We mutated the HC-CDR3 sequence of M142-H08 in order to identify amino acid substitutions that prevent the cleavage of the IgG that occurs while retaining the binding and inhibitor properties of M142-H08. Previous experience with similarly "clipped" antibodies suggested that focusing simply on the putative P1 position (protease subsite 1, see Table 4) may not be sufficient to identify antibodies that retain potent inhibition of the target enzyme while not being clipped by a host cell protease. Therefore, we created a small library of single point mutations in the region around the cleavage site in order to identify variants of M142-H08 that are not clipped but are still potent pKal inhibitors. We refer to this library as the "CDR3 by Design" library. The small library was constructed using a PCR primer that contains the randomized codon NNK at either the P3, the P2, the P1, or the P1' site. This results in a small library where each of the 4 positions may contain any of the 20 amino acids (20+20+20+20=80 members). Using PCR, this library was cloned into the M142-H08 Fab sequence in the pMid21 vector, which is a standard phagemid vector.

TABLE 4

Primer sequences

| Primer Name | Sequence | | | | | | | | | | | | | | N |
|---|---|---|---|---|---|---|---|---|---|---|---|---|---|---|---|
| | | | | | P3 | P2 | P1 | P1' | P2' | | | | | | |
| | G | G | L | L | L | W | F | R | E | L | K | S | N | Y | |
| | | | | | | | | | | (SEQ ID NO: 2581) | | | | | |
| 559A.P1.top | GGC | GGT | CTA | TTA | CTA | TGG | TTC | NNK | GAG | CTG | AAG | TCT | AAC | TAC | 20 |
| | | | | | | | | | | (SEQ ID NO: 900) | | | | | |
| 559A.P2.top | GGC | GGT | CTA | TTA | CTA | TGG | NNK | AGG | GAG | CTG | AAG | TCT | AAC | TAC | 20 |
| | | | | | | | | | | (SEQ ID NO: 901) | | | | | |
| 559A.P3.top | GGC | GGT | CTA | TTA | CTA | NNK | TTC | AGG | GAG | CTG | AAG | TCT | AAC | TAC | 20 |
| | | | | | | | | | | (SEQ ID NO: 902) | | | | | |
| 559A.P1p.top | GGC | GGT | CTA | TTA | CTA | TGG | TTC | AGG | NNK | CTG | AAG | TCT | AAC | TAC | 20 |
| | | | | | | | | | | (SEQ ID NO: 903) | | | | | |

By DNA sequencing, we recovered 61 of the possible 80 antibodies (Table 5). These antibodies were produced as Fab fragments in small scale (~20 μg) and tested for inhibition against human pKal in an in vitro protease cleavage assay using Pro-Phe-Arg-aminomethylcoumarin as the synthetic peptide substrate. The Fabs that were found to be inhibitors of human pKal were subcloned into our pBRH1f vector (a vector for transient expression of IgGs in 293T cells) for conversion to full length human IgG1 antibodies. Five antibodies were then expressed in 293T cells and purified by protein A sepharose chromatography. The antibodies were analyzed by SDS-PAGE to determine which of the inhibitory mutants are not cleaved by the host cell protease(s) (data not shown). The cleaved antibodies (559A-X67-G05, 559A-X67-H01, 559A-X67-G09) had an extra band that migrated between the 38 and the 49 kDa molecular weight marker. This band is absent in the 559A-X67-H04 and 559A-X67-D03 antibodies, which indicates that these antibodies are intact.

$K_{i,app}$ values were determined by steady state enzyme kinetics for those that were shown by SDS-PAGE to be not cleaved (Table 5). Interestingly, the P2 position was the only position where amino acid substitutions yielded intact antibody inhibitors of pKal. Of the 14 different mutations that were recovered at the P3 position (Table 5), only one mutant (W to L) was found to be a pKal inhibitor as a Fab but it was subsequently shown to be clipped as an IgG. None of the 16 different mutations at the P1 position (Table 5) were found to be pKal inhibitors. Eight of the 15 different mutations at the P1' position were found to be inhibitors of pKal as a Fab but all were clipped as an IgG. Consequently, only mutations at the P2 position led to antibody inhibitors that were not clipped during expression. Of the 16 different mutations that were recovered at the P2 position (Table 5), eight mutants were found to be a pKal inhibitor as a Fab but it was subsequently shown to be clipped as an IgG. Four mutants at the P2 position were found to have subnanomolar $K_{i,app}$ values: X67-G04 (F to A), X67-C03 (F to M), X67-F01 (F to Q) and X67-D03 (F to N). The antibody with the highest potency is X67-D03 ($K_{i,app}$=0.1 nM). The two antibodies shown in Table 6 were not cleaved when expressed as IgGs and were found to inhibit pKal with a subnanomolar $K_{i,app}$.

DNA and amino acid sequence alignments of the light chains of nongermlined (X63-G06) and germlined, codon optimized (X81-B01) versions of the same antibody discovered using ROLIC affinity maturation are shown in FIGS. 4 and 5, respectively. DNA and amino acid sequence alignments of the heavy chains of nongermlined (X63-G06) and germlined, codon optimized (X81-B01) versions of the same antibody discovered using ROLIC affinity maturation are shown in FIGS. 6 and 7, respectively.

TABLE 5

HV-CDR3 Sequences Obtained from "CDR3 by Design" Library*
(SEQ ID NOS 904-965, respectively, in order of appearance)

| Mutation Site | Antibody I.D. | HV-CDR3 | Inhibit as a Fab | Intact as an IgG? | Ki, app as an IgG (nM) |
|---|---|---|---|---|---|
| Parental | X69-009 | GGLLLWFRELKSNYFDY | Yes | No | 0.2 |
| P3 | X68-E07 | GGLLLAFRELKSNYFDY | No | n/a | n/a |
| P3 | X68-E12 | GGLLLCFRELKSNYFDY | No | n/a | n/a |
| P3 | X68-A03 | GGLLLDFRELKSNYFDY | No | n/a | n/a |
| P3 | X68-E03 | GGLLLEFRELKSNYFDY | No | n/a | n/a |
| P3 | X68-A12 | GGLLLGFRELKSNYFDY | No | n/a | n/a |
| P3 | X68-D11 | GGLLLKFRELKSNYFDY | No | n/a | n/a |
| P3 | X68-E01 | GGLLLLFRELKSNYFDY | Yes | No | n/a |
| P3 | X68-F05 | GGLLLMFRELKSNYFDY | No | n/a | n/a |

TABLE 5-continued

HV-CDR3 Sequences Obtained from "CDR3 by Design" Library*
(SEQ ID NOS 904-965, respectively, in order of appearance)

| Mutation Site | Antibody I.D. | HV-CDR3 | Inhibit as a Fab | Intact as an IgG? | Ki, app as an IgG (nM) |
|---|---|---|---|---|---|
| P3 | X68-D10 | GGLLLPFRELKSNYFDY | No | n/a | n/a |
| P3 | X68-F10 | GGLLLQFRELKSNYFDY | No | n/a | n/a |
| P3 | X68-G01 | GGLLLRFRELKSNYFDY | No | n/a | n/a |
| P3 | X68-G05 | GGLLLSFRELKSNYFDY | No | n/a | n/a |
| P3 | X68-F12 | GGLLLTFRELKSNYFDY | No | n/a | n/a |
| P3 | X68-H04 | GGLLLVFRELKSNYFDY | No | n/a | n/a |
| P2 | X67-G04 | GGLLLWARELKSNYFDY | Yes | Yes | 0.35 |
| P2 | X67-G01 | GGLLLWCRELKSNYFDY | No | n/a | n/a |
| P2 | X67-E04 | GGLLLWDRELKSNYFDY | Yes | Yes | 1.3 |
| P2 | X67-H04 | GGLLLWERELKSNYFDY | Yes | Yes | 3.6 |
| P2 | X67-C09 | GGLLLWGRELKSNYFDY | Yes | Yes | 8.6 |
| P2 | X67-B04 | GGLLLWKRELKSNYFDY | Yes | No | n/a |
| P2 | X67-G09 | GGLLLWLRELKSNYFDY | Yes | No | n/a |
| P2 | X67-C03 | GGLLLWMRELKSNYFDY | Yes | Yes | 0.7 |
| P2 | X67-D03 | GGLLLWNRELKSNYFDY | Yes | Yes | 0.1 |
| P2 | X67-B05 | GGLLLWPRELKSNYFDY | No | n/a | n/a |
| P2 | X67-F01 | GGLLLWQRELKSNYFDY | Yes | Yes | 0.9 |
| P2 | X67-G05 | GGLLLWRRELKSNYFDY | Yes | No | n/a |
| P2 | X67-B03 | GGLLLWSRELKSNYFDY | Yes | Yes | 2.1 |
| P2 | X67-F10 | GGLLLWTRELKSNYFDY | Yes | Yes | 1.3 |
| P2 | X67-H01 | GGLLLWWRELKSNYFDY | Yes | No | n/a |
| P2 | X67-F08 | GGLLLWYRELKSNYFDY | Yes | No | n/a |
| P1 | X66-E09 | GGLLLWFAELKSNYFDY | No | n/a | n/a |
| P1 | X66-B05 | GGLLLWFCELKSNYFDY | No | n/a | n/a |
| P1 | X66-D03 | GGLLLWFEELKSNYFDY | No | n/a | n/a |
| P1 | X66-H04 | GGLLLWFFELKSNYFDY | No | n/a | n/a |
| P1 | X66-H02 | GGLLLWFGELKSNYFDY | No | n/a | n/a |
| P1 | X66-C11 | GGLLLWFHELKSNYFDY | No | n/a | n/a |
| P1 | X66-A07 | GGLLLWFKELKSNYFDY | No | n/a | n/a |
| P1 | X66-C03 | GGLLLWFLELKSNYFDY | No | n/a | n/a |
| P1 | X66-G05 | GGLLLWFMELKSNYFDY | No | n/a | n/a |
| P1 | X66-F10 | GGLLLWFPELKSNYFDY | No | n/a | n/a |
| P1 | X66-E04 | GGLLLWFQELKSNYFDY | No | n/a | n/a |
| P1 | X66-F01 | GGLLLWFSELKSNYFDY | No | n/a | n/a |
| P1 | X66-H11 | GGLLLWFTELKSNYFDY | No | n/a | n/a |
| P1 | X66-C02 | GGLLLWFVELKSNYFDY | No | n/a | n/a |

TABLE 5-continued

HV-CDR3 Sequences Obtained from "CDR3 by Design" Library*
(SEQ ID NOS 904-965, respectively, in order of appearance)

| Mutation Site | Antibody I.D. | HV-CDR3 | Inhibit as a Fab | Intact as an IgG? | Ki, app as an IgG (nM) |
|---|---|---|---|---|---|
| P1 | X66-F09 | GGLLLWFWELKSNYFDY | No | n/a | n/a |
| P1 | X66-G08 | GGLLLWFYELKSNYFDY | No | n/a | n/a |
| P1' | X69-D08 | GGLLLWFRALKSNYFDY | No | n/a | n/a |
| P1' | X69-B02 | GGLLLWFRCLKSNYFDY | No | n/a | n/a |
| P1' | X69-D09 | GGLLLWFRGLKSNYFDY | Yes | No | n/a |
| P1' | X69-D02 | GGLLLWFRHLKSNYFDY | No | n/a | n/a |
| P1' | X69-A12 | GGLLLWFRKLKSNYFDY | No | n/a | n/a |
| P1' | X69-F05 | GGLLLWFRLLKSNYFDY | Yes | No | n/a |
| P1' | X69-B08 | GGLLLWFRNLKSNYFDY | Yes | No | n/a |
| P1' | X69-A10 | GGLLLWFRPLKSNYFDY | No | n/a | n/a |
| P1' | X69-A09 | GGLLLWFRQLKSNYFDY | Yes | No | n/a |
| P1' | X69-E05 | GGLLLWFRRLKSNYFDY | No | n/a | n/a |
| P1' | X69-F09 | GGLLLWFRSLKSNYFDY | Yes | No | n/a |
| P1' | X69-F01 | GGLLLWFRTLKSNYFDY | Yes | No | n/a |
| P1' | X69-C12 | GGLLLWFRVLKSNYFDY | Yes | No | n/a |
| P1' | X69-E01 | GGLLLWFRWLKSNYFDY | Yes | No | n/a |
| P1' | X69-H10 | GGLLLWFRYLKSNYFDY | No | n/a | n/a |

*All of these antibodies are single point mutations of the M142-H08 sequence.

Amino acid sequences of light chain (LC) and heavy chain (HC) variable domain of pKal antibodies with designed HC CDR3s are shown below (SEQ ID NOS 966-1089, respectively, in order of appearance).

```
X68-E07 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X68-E07 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLAFRELKS NYFDYWGQGT     120
LVTVSSASTK GPSVFPLAPS SKS                                            143

X68-E12 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X68-E12 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLCFRELKS NYFDYWGQGT     120
LVTVSSASTK GPSVFPLAPS SKS                                            143

X68-A03 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X68-A03 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLDFRELKS NYFDYWGQGT     120
LVTVSSASTK GPSVFPLAPS SKS                                            143

X68-E03 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108
```

-continued

```
X68-E03 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLEFRELKS NYFDYWGQGT     120
LVTVSSASTK GPSVFPLAPS SKS                                            143

X68-A12 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X68-A12 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLGFRELKS NYFDYWGQGT     120
LVTVSSASTK GPSVFPLAPS SKS                                            143

X68-D11 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X68-D11 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLKFRELKS NYFDYWGQGT     120
LVTVSSASTK GPSVFPLAPS SKS                                            143

X68-E01 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X68-E01 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLLFRELKS NYFDYWGQGT     120
LVTVSSASTK GPSVFPLAPS SKS                                            143

X68-F05 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X68-F05 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLMFRELKS NYFDYWGQGT     120
LVTVSSASTK GPSVFPLAPS SKS                                            143

X68-D10 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X68-D10 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLPFRELKS NYFDYWGQGT     120
LVTVSSASTK GPSVFPLAPS SKS                                            143

X68-F10 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X68-F10 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLQFRELKS NYFDYWGQGT     120
LVTVSSASTK GPSVFPLAPS SKS                                            143

X68-G01 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X68-G01 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLRFRELKS NYFDYWGQGT     120
LVTVSSASTK GPSVFPLAPS SKS                                            143

X68-G05 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X68-G05 HC
EVQLLESGGG LVQPGGSLRL SCAASGFTFS AYSMIWVRQA PGKGLEWVSY IRPSGGRTTY      60
ADSVKGRFTI SRDNSKNILY LQMNSLRAED TAVYYCARGG LLLSFRELKS NYFDYWGQGT     120
LVTVSSASTK GPSVFPLAPS SKS                                            143

X68-F12 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108
```

-continued

```
X68-F12 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLTFRELKS NYFDYWGQGT     120
LVTVSSASTK GPSVFPLAPS SKS                                            143

X68-H04 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X68-H04 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLVFRELKS NYFDYWGQGT     120
LVTVSSASTK GPSVFPLAPS SKS                                            143

X67-G04 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X67-G04 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWARELKS NYFDYWGQGT     120
LVTVSSASTK GPSVFPLAPS SKS                                            143

X67-G01 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X67-G01 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWCRELKS NYFDYWGQGT     120
LVTVSSASTK GPSVFPLAPS SKS                                            143

X67-E04 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X67-E04 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWDRELKS NYFDYWGQGT     120
LVTVSSASTK GPSVFPLAPS SKS                                            143

X67-H04 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X67-H04 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWERELKS NYFDYWGQGT     120
LVTVSSASTK GPSVFPLAPS SKS                                            143

X66-E09 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X66-E09 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFAELKS NYFDYWGQGT     120
LVTVSSASTK GPSVFPLAPS SKS                                            143

X66-B05 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X66-B05 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFCELKS NYFDYWGQGT     120
LVTVSSASTK GPSVFPLAPS SKS                                            143

X66-D03 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X66-D03 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFEELKS NYFDYWGQGT     120
LVTVSSASTK GPSVFPLAPS SKS                                            143

X66-H04 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108
```

-continued

X66-H04 HC
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFFELKS NYFDYWGQGT   120
LVTVSSASTK GPSVFPLAPS SKS                                          143

X66-H02 LC
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-H02 HC
EVQLLESGGG LVQPGGSLRL SCAASGFTFS AYSMIWVRQA PGKGLEWVSY IRPSGGRTTY    60
ADSVKGRFTI SRDNSKNTLY LQMHSLRAED TAVYYCARGG LLLWFGELKS NYFDYWGQGT   120
LVTVSSASTK GPSVFPLAPS SKS                                          143

X66-C11 LC
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-C11 HC
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFHELKS NYFDYWGQGT   120
LVTVSSASTK GPSVFPLAPS SKS                                          143

X66-A07 LC
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-A07 HC
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFKELKS NYFDYWGQGT   120
LVTVSSASTK GPSVFPLAPS SKS                                          143

X66-C03 LC
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-C03 HC
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFLELKS NYFDYWGQGT   120
LVTVSSASTK GPSVFPLAPS SKS                                          143

X66-G05 LC
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-G05 HC
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFMELKS NYFDYWGQGT   120
LVTVSSASTK GPSVFPLAPS SKS                                          143

X66-F10 LC
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-F10 HC
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFPELKS NYFDYWGQGT   120
LVTVSSASTK GPSVFPLAPS SKS                                          143

X66-E04 LC
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X66-E04 HC
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFQELKS NYFDYWGQGT   120
LVTVSSASTK GPSVFPLAPS SKS                                          143

X69-D08 LC
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

X69-D08 HC
EVQLLESGGG LVQPGGSLRL SCAASGFTFS AYSMIWVRQA PGKGLEWVSY IRPSGGRTTY    60
ADSVKGRFTI SRDNSKNTLY LQMNSLRAED TAVYYCARGG LLLWFRALKS NYFDYWGQGT   120
LVTVSSASTK GPSVFPLAPS SKS                                          143

X69-B02 LC
QDIQMTQSPS SLSAFVGDRV TITCRASQPI DNYLNWYHQK PGKAPKLLIY AASRLQSGVP    60
SRLSGSGFGT DFTLTISSLQ PEDFGNYYCQ QSYTVPYTFG GGTKVEIR                108

-continued

X69-B02 HC
EVQLLESGGG LVQPGGSLRL SCAASGFTFS AYSMIWVRQA PGKGLEWVSY IRPSGGRTTY        60
ADSVKGRFTI SRDNSKNTLY LQMNSLRAED TAVYYCARGG LLLWFRCLKS NYFDYWGQGT       120
LVTVSSASTK GPSVFPLAPS SKS                                               143

X69-009 LC
QDIQMTQSPS SLSAFVGDRV TITCRASQPI DNYLNWYHQK PGKAPKLLIY AASRLQSGVP        60
SRLSGSGFGT DFTLTISSLQ PEDFGNYYCQ QSYTVPYTFG GGTKVEIR                    108

X69-009 HC
EVQLLESGGG LVQPGGSLRL SCAASGFTFS AYSMIWVRQA PGKGLEWVSY IRPSGGRTTY        60
ADSVKGRFTI SRDNSKNTLY LQMNSLRAED TAVYYCARGG LLLWFRELKS NYFDYWGQGT       120
LVTVSSASTK GPSVFPLAPS SKS                                               143

X69-D09 LC
QDIQMTQSPS SLSAFVGDRV TITCRASQPI DNYLNWYHQK PGKAPKLLIY AASRLQSGVP        60
SRLSGSGFGT DFTLTISSLQ PEDFGNYYCQ QSYTVPYTFG GGTKVEIR                    108

X69-D09 HC
EVQLLESGGG LVQPGGSLRL SCAASGFTFS AYSMIWVRQA PGKGLEWVSY IRPSGGRTTY        60
ADSVKGRFTI SRDNSKNTLY LQMNSLRAED TAVYYCARGG LLLWFRGLKS NYFDYWGQGT       120
LVTVSSASTK GPSVFPLAPS SKS                                               143

X69-D02 LC
QDIQMTQSPS SLSAFVGDRV TITCRASQPI DNYLNWYHQK PGKAPKLLIY AASRLQSGVP        60
SRLSGSGFGT DFTLTISSLQ PEDFGNYYCQ QSYTVPYTFG GGTKVEIR                    108

X69-D02 HC
EVQLLESGGG LVQPGGSLRL SCAASGFTFS AYSMIWVRQA PGKGLEWVSY IRPSGGRTTY        60
ADSVKGRFTI SRDNSKNTLY LQMNSLRAED TAVYYCARGG LLLWFRHLKS NYFDYWGQGT       120
LVTVSSASTK GPSVFPLAPS SKS                                               143

X69-A12 LC
QDIQMTQSPS SLSAFVGDRV TITCRASQPI DNYLNWYHQK PGKAPKLLIY AASRLQSGVP        60
SRLSGSGFGT DFTLTISSLQ PEDFGNYYCQ QSYTVPYTFG GGTKVEIR                    108

X69-A12 HC
EVQLLESGGG LVQPGGSLRL SCAASGFTFS AYSMIWVRQA PGKGLEWVSY IRPSGGRTTY        60
ADSVKGRFTI SRDNSKNTLY LQMNSLRAED TAVYYCARGG LLLWFRKLKS NYFDYWGQGT       120
LVTVSSASTK GPSVFPLAPS SKS                                               143

X69-F05 LC
QDIQMTQSPS SLSAFVGDRV TITCRASQPI DNYLNWYHQK PGKAPKLLIY AASRLQSGVP        60
SRLSGSGFGT DFTLTISSLQ PEDFGNYYCQ QSYTVPYTFG GGTKVEIR                    108

X69-F05 HC
EVQLLESGGG LVQPGGSLRL SCAASGFTFS AYSMIWVRQA PGKGLEWVSY IRPSGGRTTY        60
ADSVKGRFTI SRDNSKNTLY LQMNSLRAED TAVYYCARGG LLLWFRLLKS NYFDYWGQGT       120
LVTVSSASTK GPSVFPLAPS SKS                                               143

X69-B08 LC
QDIQMTQSPS SLSAFVGDRV TITCRASQPI DNYLNWYHQK PGKAPKLLIY AASRLQSGVP        60
SRLSGSGFGT DFTLTISSLQ PEDFGNYYCQ QSYTVPYTFG GGTKVEIR                    108

X69-B08 HC
EVQLLESGGG LVQPGGSLRL SCAASGFTFS AYSMIWVRQA PGKGLEWVSY IRPSGGRTTY        60
ADSVKGRFTI SRDNSKNTLY LQMNSLRAED TAVYYCARGG LLLWFRNLKS NYFDYWGQGT       120
LVTVSSASTK GPSVFPLAPS SKS                                               143

X69-A10 LC
QDIQMTQSPS SLSAFVGDRV TITCRASQPI DNYLNWYHQK PGKAPKLLIY AASRLQSGVP        60
SRLSGSGFGT DFTLTISSLQ PEDFGNYYCQ QSYTVPYTFG GGTKVEIR                    108

X69-A10 HC
EVQLLESGGG LVQPGGSLRL SCAASGFTFS AYSMIWVRQA PGKGLEWVSY IRPSGGRTTY        60
ADSVKGRFTI SRDNSKNTLY LQMNSLRAED TAVYYCARGG LLLWFRPLKS NYFDYWGQGT       120
LVTVSSASTK GPSVFPLAPS SKS                                               143

X69-A09 LC
QDIQMTQSPS SLSAFVGDRV TITCRASQPI DNYLNWYHQK PGKAPKLLIY AASRLQSGVP        60
SRLSGSGFGT DFTLTISSLQ PEDFGNYYCQ QSYTVPYTFG GGTKVEIR                    108

X69-A09 HC
EVQLLESGGG LVQPGGSLRL SCAASGFTFS AYSMIWVRQA PGKGLEWVSY IRPSGGRTTY        60
ADSVKGRFTI SRDNSKNTLY LQMNSLRAED TAVYYCARGG LLLWFRQLKS NYFDYWGQGT       120
LVTVSSASTK GPSVFPLAPS SKS                                               143

X69-E05 LC
QDIQMTQSPS SLSAFVGDRV TITCRASQPI DNYLNWYHQK PGKAPKLLIY AASRLQSGVP        60
SRLSGSGFGT DFTLTISSLQ PEDFGNYYCQ QSYTVPYTFG GGTKVEIR                    108

```
X69-E05 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFRRLKS NYFDYWGQGT     120
LVTVSSASTK GPSVFPLAPS SKS                                             143

X69-F09 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X69-F09 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFRSLKS NYFDYWGQGT     120
LVTVSSASTK GPSVFPLAPS SKS                                             143

X69-F01 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X69-F01 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFRTLKS NYFDYWGQGT     120
LVTVSSASTK GPSVFPLAPS SKS                                             143

X69-C12 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X69-C12 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFRVLKS NYFDYWGQGT     120
LVTVSSASTK GPSVFPLAPS SKS                                             143

X69-E01 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X69-E01 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFRWLKS NYFDYWGQGT     120
LVTVSSASTK GPSVFPLAPS SKS                                             143

X69-H10 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X69-H10 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFRYLKS NYFDYWGQGT     120
LVTVSSASTK GPSVFPLAPS SKS                                             143

X66-F01 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X66-F01 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFSELKS NYFDYWGQGT     120
LVTVSSASTK GPSVFPLAPS SKS                                             143

X66-H11 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X66-H11 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFTELKS NYFDYWGQGT     120
LVTVSSASTK GPSVFPLAPS SKS                                             143

X66-C02 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X66-C02 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFVELKS NYFDYWGQGT     120
LVTVSSASTK GPSVFPLAPS SKS                                             143

X66-F09 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108
```

-continued

```
X66-F09 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFWELKS NYFDYWGQGT     120
LVTVSSASTK GPSVFPLAPS SKS                                            143

X66-G08 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X66-G08 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWFYELKS NYFDYWGQGT     120
LVTVSSASTK GPSVFPLAPS SKS                                            143

X67-C09 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X67-C09 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWGRELKS NYFDYWGQGT     120
LVTVSSASTK GPSVFPLAPS SKS                                            143

X67-B04 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X67-B04 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWKRELKS NYFDYWGQGT     120
LVTVSSASTK GPSVFPLAPS SKS                                            143

X67-G09 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X67-G09 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWLRELKS NYFDYWGQGT     120
LVTVSSASTK GPSVFPLAPS SKS                                            143

X67-C03 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X67-C03 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWMRELKS NYFDYWGQGT     120
LVTVSSASTK GPSVFPLAPS SKS                                            143

X67-D03 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X67-D03 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWNRELKS NYFDYWGQGT     120
LVTVSSASTK GPSVFPLAPS SKS                                            143

X67-B05 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X67-B05 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWPRELKS NYFDYWGQGT     120
LVTVSSASTK GPSVFPLAPS SKS                                            143

X67-F01 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108

X67-F01 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWQRELKS NYFDYWGQGT     120
LVTVSSASTK GPSVFPLAPS SKS                                            143

X67-G05 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                 108
```

-continued

```
X67-G05 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWRRELKS NYFDYWGQGT     120
LVTVSSASTK GPSVFPLAPS SKS                                             143

X67-B03 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X67-B03 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWSRELKS NYFDYWGQGT     120
LVTVSSASTK GPSVFPLAPS SKS                                             143

X67-F10 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X67-F10 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWTRELKS NYFDYWGQGT     120
LVTVSSASTK GPSVFPLAPS SKS                                             143

X67-H01 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X67-H01 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWWRELKS NYFDYWGQGT     120
LVTVSSASTK GPSVFPLAPS SKS                                             143

X67-F08 LC
QDIQMTQSPS SLSAFVGDRV TITCRASQPI DNYLNWYHQK PGKAPKLLIY AASRLQSGVP      60
SRLSGSGFGT DFTLTISSLQ PEDFGNYYCQ QSYTVPYTFG GGTKVEIR                  108

X67-F08 HC
EVQLLESGGG LVQPGGSLRL SCAASGFTFS AYSMIWVRQA PGKGLEWVSY IRPSGGRTTY      60
ADSVKGRFTI SRDNSKNTLY LQMNSLRAED TAVYYCARGG LLLWYRELKS NYFDYWGQGT     120
LVTVSSASTK GPSVFPLAPS SKS                                             143
```

TABLE 6

CDR Amino Acid Sequences of Optimized Antibody Inhibitor of pKal Based on M142-H08
(SEQ ID NOS 1090-1101, respectively, in order of appearance)

| Initial Name | Ki, app (nM) of IgG | LV-CDR1 | LV-CDR2 | LV-CDR3 | HV-CDR1 | HV-CDR2 | HV-CDR3[a] |
|---|---|---|---|---|---|---|---|
| X67-D03 | 0.1 | RASQPIDNYLN | AASRLQS | QQSYTVPYT | AYSMI | YIRPSGGRTTYADSVKG | GGLLLWNRELKSNYFDY |
| X67-G04 | 0.35 | RASQPIDNYLN | AASRLQS | QQSYTVPYT | AYSMI | YIRPSGGRTTYADSVKG | GGLLLWARELKSNYFDY |

[a]The F to N substitution (in bold) in the CDR3 of the M142-H08 gives X67-D03, an IgG that is not cleaved during expression and is a potent inhibitor of human. Similarly, the F to A substitution gives X67-G04, which is also not cleaved.

TABLE 7

CDR Amino Acid Sequences of Affinity Matured Antibody Inhibitors of pKal Discovered using ROLIC
(SEQ ID NOS 1102-1137, respectively, in order of appearance)

| Initial Name | Ki, app (nm) | LV-CDR1 | LV-CDR2 | LV-CDR3 | HV-CDR1 | HV-CDR2 | HV-CDR3 |
|---|---|---|---|---|---|---|---|
| X59-007 | 6.1 | RAGRSISTYVN | AASSLQS | QQSQSTPYT | HYLMT | YISPSGGHTIYADSVKG | VARGIAARSRTSYFDY |
| X60-D01 | 2.0 | RASQIVSSRYLA | GAASRAT | QQTYSSPFT | HYLMT | YISPSGGHTIYADSVKG | VARGIAARSRTSYFDY |
| X63-G10 | 9.0 | RASQSISNYLN | AASSLQS | QQSYTSPYT | HYLMT | YISPSGGHTIYADSVKG | VARGIAARSRTSYFDY |
| X64-F04 | 1.9 | RASQIVSSNYLA | GASNRAT | QQSFNIPYT | HYLMT | YISPSGGHTIYADSVKG | VARGIAARSRTSYFDY |

TABLE 7-continued

CDR Amino Acid Sequences of Affinity Matured Antibody Inhibitors of pKal Discovered using ROLIC
(SEQ ID NOS 1102-1137, respectively, in order of appearance)

| Initial Name | Ki, app (nm) | LV-CDR1 | LV-CDR2 | LV-CDR3 | HV-CDR1 | HV-CDR2 | HV-CDR3 |
|---|---|---|---|---|---|---|---|
| X63-G06 | 0.4 (Fab) | RTSQFVNSNYLA | GASSRAT | QQSSRTPWT | HYLMT | YISPSGGHTIYADSVKG | VARGIAARSRTSYFDY |
| X81-B01a | 0.2 (IgG) | RTSQFVNSNYLA | GASSRAT | QQSSRTPWT | HYLMT | YISPSGGHTIYADSVKG | VARGIAARSRTSYFDY |

<sup>a</sup>X81-B01 is the codon optimized and germlined version of X63-G06 as a full length human IgG produced in HEK 293T? cells.

Amino acid sequences of light chain (LC) and heavy chain (HC) variable domain of affinity matured antibody inhibitors of pKal discovered using ROLIC are shown below (SEQ ID NOS 1138-1147, respectively, in order of appearance).

```
X59-C07 LC
QDIQMTQSPS SLSASVGDRV TVTCRAGRSI STYVNWYQQK PGKAPKLLIY AASSLQSGVP    60
SRFSGSRSGT DFTLTISSLQ PEDFATYYCQ QSQSTPYTFG QGTKLEVK               108

X59-C07 HC
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

X60-D01 LC
QDIQMTQSPG TLSLSPGERA TLSCRASQIV SSRYLAWYQQ RPGQAPRLLI YGAASRATGI    60
PDRFSGSGSG TDFTLTISSL QAEDFATYYC QQTYSSPFTF GQGTKMEIK              109

X60-D01 HC
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

X63-G06 LC
QDIQMTQSPG TLSLSPGERA TLSCRTSQFV NSNYLAWYQQ TPGQAPRLLI YGASSRATGI    60
PDRFSGTGYG TDFTLTISRL EPEDYGTYYC QQSSRTPWTF GQGTRVEIK              109

X63-G06 HC
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

X63-G10 LC
QDIQMTQSPD SLSASVGDRV TITCRASQSI SNYLNWYQQK PGKAPKLLIY AASSLQSGVP    60
SRFSGSGSGT DFTLTISGLQ PEDFASYYCQ QSYTSPYTFV QGTKLEIKRT             110

X63-G10 HC
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDYWGQGTL   120
VTVSSASTKG PSVFPLAPSS KS                                           142

X64-F04 LC
QDIQMTQSPA TLSLSPGERA TLSCRASQIV SSNYLAWYQQ KPGQAPRLLI YGASNRATGI    60
PDRFSGSGSG TEFTLTISSL QSEDFAIYYC QQSFNIPYTF GQGTRVDIK              109

X64-F04 HC
EVQLLESGGG LVQPGGSLRL SCAASGFTFS HYLMTWVRQA PGKGLEWVSY ISPSGGHTIY    60
ADSVKGRFTI SRDNSKNTLY LQMNSLRAED TAVYYCARVA RGIAARSRTS YFDYWGQGTL   120
VTVSSASTKG PSVFPLAPSS KS                                           142
```

X81-B01 is the germlined IgG produced in HEK 293T cells version of the X63-G06 Fab, as indicated above.

X101-A01 (aka DX-2922) is the germlined IgG produced in CHO cells version of the X63-G06 Fab

Example 4

Affinity Maturation

In addition to optimizing the sequence of the clipped antibody (M142-H08), we also performed affinity maturation on two of the antibodies identified by phage display (M162-A04 and M160-G12). Both of these antibodies inhibit human pKal with single digit nanomolar potency, appear specific to pKal, and do not bind prekallikrein (Table 3). We first performed a novel form of light chain shuffling called ROLIC (Rapid Optimization of Light Chains) on M162-A04 and M160-G12 (see, e.g., WO 2009/102927 and U.S. 2009-0215119). From the screening of the antibodies discovered by ROLIC we identified one antibody with subnamolar potency (X63-G06) that shared the same heavy chain as M160-G12. We then constructed HV-CDR3 spiking affinity maturation libraries based on CDR3 sequences in M162-A04 and X63-G06 (described below).

Affinity Maturation by ROLIC.

We used ROLIC to affinity mature the two leads from Table 3 that were not cleaved (M162-A04 and M160-G12). This process identified one antibody that inhibits pKal with a sub-nanomolar $K_{i,app}$ (Table 7). X63-G06 inhibits pKal with a $K_{i,app}$ of approximately 0.4 nM as a Fab fragment. When this antibody was converted to an IgG that is germlined and sequenced optimized for CHO cell expression (X81-B01) it was found to inhibit pKal with a $K_{i,app}$ of approximately 0.2 nM.

Example 5

Affinity Maturation of Heavy Chain CDR1/2 and CDR3

We used two additional affinity maturation strategies to identify highly potent antibodies based on two different parental antibody inhibitor leads: M162-A04 and X63-G06. One approach was to generate libraries that shuffled the CDR1/2 of the HC of two different parental antibody inhibitor leads (M162-A04 and X63-G06) against additional CDR1/2 diversity. Another approach was to create heavy chain CDR3 spiking libraries based on these leads.

The 82 antibodies that were discovered based on improvements in M162-A04 due to modifications in either the CDR1/2 and CDR3 region are shown in Table 8. Inhibition screening with 10 nM antibody (as Fab fragments) revealed that there were 33 antibodies that inhibited pKal activity by over 90%. Several antibodies were shown to be subnanomolar inhibitors of human pKal.

The 62 antibodies that were discovered based on improvements in X63-G06 due to modifications in either the CDR1/2 and CDR3 region are shown in Table 9. Inhibition screening with 10 nM antibody (as Fab fragments) revealed that there were 24 antibodies that inhibited pKal activity by over 90%. Several antibodies were shown to be subnanomolar inhibitors of human pKal.

TABLE 8

Sequences of Antibodies Obtained from CDR1/2 and CDR3 Spiking Affinity Maturation Libraries Based on M162-A04
(SEQ ID NOS 1148-1639, respectively, in order of appearance)

| Antibody I.D. | % inhibition at 10 nM | human pKal Ki, app (nM) | LV-CDR1 | LV-CDR2 | LV-CDR3 | HV-CDR1 | HV-CDR2 | HV-CDR3 |
|---|---|---|---|---|---|---|---|---|
| M202-A12 | 97.5 | 0.2 | RASQSISSWLA | KASTLES | QQYNTYWT | HYIMM | GIYSSGGITVYADSVKG | QRTGVPRRDSFNI |
| M196-006 | 97.2 | 0.1 | RASQSISSWLA | KASTLES | QQYNTYWT | IYSMH | SIYPSRGMTWYADSVKG | RRTGIPRRDAFDI |
| M198-F09 | 96.9 | 0.2 | RASQSISSWLA | KASTLES | QQYNTYWT | VYNMH | SIYPSGGMTYYADSVKG | RRTGIPRRDAFDI |
| M199-A08 | 96.4 | 0.06 | RASQSISSWLA | KASTLES | QQYNTYWT | HYIMM | GIYSSGGITVYADSVKG | RRIGVPRRDEFDI |
| M202-001 | 96.3 | 0.1 | RASQSISSWLA | KASTLES | QQYNTYWT | HYIMM | GIYSSGGITVYADSVKG | RRTGVPRWDDFDI |
| M198-A06 | 96.1 | 0.4 | RASQSISSWLA | KASTLES | QQYNTYWT | IYSMH | SIYSSGGPTKYADSVKG | RRTGIPRRDAFDI |
| M200-D03 | 95.9 | 0.1 | RASQSISSWLA | KASTLES | QQYNTYWT | HYIMM | GIYSSGGITVYADSVKG | RRIGVPRRDSFDM |
| M202-H03 | 95.7 | 0.1 | RASQSISSWLA | KASTLES | QQYNTYWT | HYIMM | GIYSSGGITVYADSVKG | RRTGVPRWDDFDI |
| M201-A07 | 95.7 | 0.1 | RASQSISSWLA | KASTLES | QQYNTYWT | HYIMM | GIYSSGGITVYADSVKG | RRTGVPRRDEFDI |
| M197-A01 | 95.3 |  | RASQSISSWLA | KASTLES | QQYNTYWT | IYDMI | SIYPSGGNTSYADSVKG | RRTGIPRRDAFDI |
| M202-D09 | 95.0 | 0.4 | RASQSISSWLA | KASTLES | QQYNTYWT | HYIMM | GIYSSGGITVYADSVKG | RRIGVPRRDSFDI |
| M197-A09 | 94.9 | 0.6 | RASQSISSWLA | KASTLES | QQYNTYWT | VYNMH | SIYPSGGMTYYADSVKG | RRTGIPRRDAFDI |
| M198-G07 | 94.9 |  | RASQSISSWLA | KASTLES | QQYNTYWT | IYDMT | SIYPSGGQTIYADSVKG | RRTGIPRRDAFDI |
| M200-A10 | 94.3 | 0.3 | RASQSISSWLA | KASTLES | QQYNTYWT | HYIMM | GIYSSGGITVYADSVKG | RRTGVPRRDSFDI |
| M197-H10 | 94.1 |  | RASQSISSWLA | KASTLES | QQYNTYWT | SYNMH | SIVPSGGKTNYADSVKG | RRTGIPRRDAFDI |
| M196-D12 | 94.1 | 0.2 | RASQSISSWLA | KASTLES | QQYNTYWT | RYSMR | VIYPSGGQTYYADSVKG | RRTGIPRRDAFDI |

TABLE 8-continued

Sequences of Antibodies Obtained from CDR1/2 and CDR3 Spiking Affinity Maturation Libraries Based on M162-A04
(SEQ ID NOS 1148-1639, respectively, in order of appearance)

| Antibody I.D. | % inhibition at 10 nM | human pKal Ki, app (nM) | LV-CDR1 | LV-CDR2 | LV-CDR3 | HV-CDR1 | HV-CDR2 | HV-CDR3 |
|---|---|---|---|---|---|---|---|---|
| M197-A08 | 93.7 | | RASQSISSWLA | KASTLES | QQYNTYWT | IYSMQ | SIGSSGGKTLYADSVKG | RRTGIPRRDAFDI |
| M198-B09 | 93.5 | | RASQSISSWLA | KASTLES | QQYNTYWT | VYSMT | SIGSSGGSTTYADSVKG | RRTGIPRRDAFDI |
| M198-E09 | 93.1 | | RASQSISSWLA | KASTLES | QQYNTYWT | IYDMN | SIYPSGGRTRYADSVKG | RRTGIPRRDAFDI |
| M202-B03 | 93.1 | 0.3 | RASQSISSWLA | KASTLES | QQYNTYWT | HYIMM | GIYSSGGITVYADSVKG | RRTGVPRRDDFDI |
| M198-C10 | 93.0 | | RASQSISSWLA | KASTLES | QQYNTYWT | HYMGMN | SIVPSGGWTQYADSVKG | RRTGIPRRDAFDI |
| M197-E12 | 93.0 | | RASQSISSWLA | KASTLES | QQYNTYWT | TYTMR | SIYPSGGKTQYADSVKG | RRTGIPRRDAFDI |
| M198-F04 | 92.9 | | RASQSISSWLA | KASTLES | QQYNTYWT | IYDMW | SIRPSGGITKYADSVKG | RRTGIPRRDAFDI |
| M197-H11 | 92.9 | | RASQSISSWLA | KASTLES | QQYNTYWT | IYNMI | SIYPSGGWTTYADSVKG | RRTGIPRRDAFDI |
| M197-F01 | 92.6 | | RASQSISSWLA | KASTLES | QQYNTYWT | IYHMY | SIGPSGGPTGYADSVKG | RRTGIPRRDAFDI |
| M198-E11 | 92.5 | | RASQSISSWLA | KASTLES | QQYNTYWT | TYSMY | SIYPSGGLTWYADSVKG | RRTGIPRRDAFDI |
| M202-C09 | 92.3 | 0.3 | RASQSISSWLA | KASTLES | QQYNTYWT | HYIMM | GIYSSGGITVYADSVKG | RRIGVPRRDDFDI |
| M198-H08 | 92.3 | | RASQSISSWLA | KASTLES | QQYNTYWT | IYDMY | SIGPSGGPTAYADSVKG | RRTGIPRRDAFDI |
| M198-F08 | 91.8 | | RASQSISSWLA | KASTLES | QQYNTYWT | VYSMW | SISSSGGMTEYADSVKG | RRTGIPRRDAFDI |
| M202-E06 | 91.5 | | RASQSISSWLA | KASTLES | QQYNTYWT | HYIMM | GIYSSGGITVYADSVKG | RRRGVPRRDDFDI |
| M195-D12 | 90.8 | | RASQSISSWLA | KASTLES | QQYNTYWT | IYGMF | GIGPSGGPTKYADSVKG | RRTGIPRRDAFDI |
| M197-F03 | 90.7 | | RASQSISSWLA | KASTLES | QQYNTYWT | IYSMF | SIGPSGGVTHYADSVKG | RRTGIPRRDAFDI |
| M198-E02 | 90.3 | | RASQSISSWLA | KASTLES | QQYNTYWT | IYSMY | YIRPSGGNTKYADSVKG | RRTGIPRRDAFDI |
| M198-A02 | 89.1 | | RASQSISSWLA | KASTLES | QQYNTYWT | RYSMI | SIWSSGGATEYADSVKG | RRTGIPRRDAFDI |
| M202-A01 | 88.9 | | RASQSISSWLA | KASTLES | QQYNTYWT | HYIMM | GIYSSGGITVYADSVKG | RRIGVPRRDAFDI |
| M202-G03 | 88.3 | | RASQSISSWLA | KASTLES | QQYNTYWT | HYIMM | GIYSSGGITVYADSVKG | RRTGVPRRDSFEI |
| M195-B12 | 87.7 | | RASQSISSWLA | KASTLES | QQYNTYWT | KYWMY | YIRPSGGQTYYADSVKG | RRTGIPRRDAFDI |
| M198-A07 | 86.1 | | RASQSISSWLA | KASTLES | QQYNTYWT | RYQMH | WISPSGGITGYADSVKG | RRTGIPRRDAFDI |
| M198-H02 | 85.8 | | RASQSISSWLA | KASTLES | QQYNTYWT | PYNMY | WIVPGGVTKYADSVKG | RRTGIPRRDAFDI |
| M200-H07 | 85.4 | | RASQSISSWLA | KASTLES | QQYNTYWT | HYIMM | GIYSSGGITVYADSVKG | RRTGVPRRNAFDN |
| M201-H06 | 84.6 | | RASQSISSWLA | KASTLES | QQYNTYWT | HYIMM | GIYSSGGITVYADSVKG | RRTGVPRRDAFDI |

TABLE 8-continued

Sequences of Antibodies Obtained from CDR1/2 and CDR3 Spiking Affinity Maturation Libraries Based on M162-A04
(SEQ ID NOS 1148-1639, respectively, in order of appearance)

| Antibody I.D. | % inhibition at 10 nM | human pKal Ki, app (nM) | LV-CDR1 | LV-CDR2 | LV-CDR3 | HV-CDR1 | HV-CDR2 | HV-CDR3 |
|---|---|---|---|---|---|---|---|---|
| M202-F06 | 84.2 | | RASQSISSWLA | KASTLES | QQYNTYWT | HYIMM | GIYSSGGITVYADSVKG | RRTGVPRWDAFDI |
| M195-C12 | 84.2 | | RASQSISSWLA | KASTLES | QQYNTYWT | MYQMF | SISPGGGTQYADSVKG | RRTGIPRRDAFDI |
| M202-H05 | 84.0 | | RASQSISSWLA | KASTLES | QQYNTYWT | HYIMM | GIYSSGGITVYADSVKG | RRTGVPRRDVFDI |
| M198-005 | 83.9 | | RASQSISSWLA | KASTLES | QQYNTYWT | RYKMY | VIGPSGGATFYADSVKG | RRTGIPRRDAFDI |
| M196-H03 | 83.9 | | RASQSISSWLA | KASTLES | QQYNTYWT | RYVMW | SISPSGDTHYADSVKG | RRTGIPRRDAFDI |
| M200-E11 | 83.2 | | RASQSISSWLA | KASTLES | QQYNTYWT | HYIMM | GIYSSGGITVYADSVKG | RRTGVPRRDAFDN |
| M202-B04 | 81.9 | | RASQSISSWLA | KASTLES | QQYNTYWT | HYIMM | GIYSSGGITVYADSVKG | RRSGVPRRDDFDI |
| M202-A04 | 81.2 | | RASQSISSWLA | KASTLES | QQYNTYWT | HYIMM | GIYSSGGITVYADSVKG | RRKGIPRRDDFDI |
| M198-B12 | 80.7 | | RASQSISSWLA | KASTLES | QQYNTYWT | KYSMA | GIYPSGGRTLYADSVKG | RRTGIPRRDAFDI |
| M198-A09 | 77.3 | | RASQSISSWLA | KASTLES | QQYNTYWT | IYFMS | SIRSSGGPTWYADSVKG | RRTGIPRRDAFDI |
| M198-006 | 76.5 | | RASQSISSWLA | KASTLES | QQYNTYWT | QYFMH | YIYPSGGMTEYADSVKG | RRTGIPRRDAFDI |
| M198-009 | 75.4 | | RASQSISSWLA | KASTLES | QQYNTYWT | IYTMY | SISPSGGWTYYADSVKG | RRTGIPRRDAFDI |
| M195-B02 | 75.1 | | RASQSISSWLA | KASTLES | QQYNTYWT | PYLMW | YIGPSGGPTHYADSVKG | RRTGIPRRDAFDI |
| M198-F12 | 74.6 | | RASQSISSWLA | KASTLES | QQYNTYWT | IYTMM | SIWSGGQTKYADSVKG | RRTGIPRRDAFDI |
| M201-H08 | 74.5 | | RASQSISSWLA | KASTLES | QQYNTYWT | HYIMM | GIYSSGGITVYADSVKG | RRTGVPRRDALDN |
| M202-C02 | 74.3 | | RASQSISSWLA | KASTLES | QQYNTYWT | HYIMM | GIYSSGGITVYADSVKG | RRPGVPRRDAFDI |
| M198-C03 | 72.4 | | RASQSISSWLA | KASTLES | QQYNTYWT | RYSMS | GISPSGGETSYADSVKG | RRTGIPRRDAFDI |
| M198-A08 | 72.3 | | RASQSISSWLA | KASTLES | QQYNTYWT | WYMMQ | RISPSGGTTYADSVKG | RRTGIPRRDAFDI |
| M195-A02 | 71.3 | | RASQSISSWLA | KASTLES | QQYNTYWT | QYMMM | GISSSGGHTDYADSVK | GRRTGIPRRDAFDI |
| M197-G10 | 67.6 | | RASQSISSWLA | KASTLES | QQYNTYWT | VYAMR | SIYPSGGKTWYADSVK | GRRTGIPRRDAFDI |
| M195-G02 | 67.5 | | RASQSISSWLA | KASTLES | QQYNTYWT | PYNMM | SIWPSGGTTDYADSVK | GRRTGIPRRDAFDI |
| M196-D02 | 66.2 | | RASQSISSWLA | KASTLES | QQYNTYWT | VYSMH | VIGPSGGITLYADSVK | GRRTGIPRRDAFDI |
| M199-A11 | 65.4 | | RASQSISSWLA | KASTLES | QQYNTYWT | HYIMM | GIYSSGGITVYADSVK | GRRRGIPRRDAFDI |
| M200-F01 | 65.1 | | RASQSISSWLA | KASTLES | QQYNTYWT | HYIMM | GIYSSGGITVYADSVK | GRRMGIPRRNAFDI |
| M198-D12 | 63.5 | 0.7 | RASQSISSWLA | KASTLES | QQYNTYWT | LYVMY | YIVPSGGPTAYADSVK | GRRTGIPRRDAFDI |
| M197-C12 | 56.4 | | RASQSISSWLA | KASTLES | QQYNTYWT | PYDML | YIVSGGLTKYADSVK | GRRTGIPRRDAFDI |
| M198-G03 | 53.8 | | RASQSISSWLA | KASTLES | QQYNTYWT | QYTMV | WIYSSRANYADSVKG | RRTGIPRRDAFDI |
| M199-B01 | 53.4 | | RASQSISSWLA | KASTLES | QQYNTYWT | HYIMM | GIYSSGGITVYADSVKG | RRTGIPRRDAFDN |

TABLE 8-continued

Sequences of Antibodies Obtained from CDR1/2 and CDR3 Spiking Affinity
Maturation Libraries Based on M162-A04
(SEQ ID NOS 1148-1639, respectively, in order of appearance)

| Antibody I.D. | % inhibition at 10 nM | human pKal Ki, app (nM) | LV-CDR1 | LV-CDR2 | LV-CDR3 | HV-CDR1 | HV-CDR2 | HV-CDR3 |
|---|---|---|---|---|---|---|---|---|
| M202-A08 | 52.9 | | RASQSISSWLA | KASTLES | QQYNTYWT | HYIMM | GIYSSGGITVYADS-VKG | RRTGIPRWDAFDI |
| M195-A12 | 51.7 | | RASQSISSWLA | KASTLES | QQYNTYWT | PYMMM | GIYPSGGYTVYADS-VKG | RRTGIPRRDAFDI |
| M202-E03 | 51.4 | | RASQSISSWLA | KASTLES | QQYNTYWT | HYIMM | GIYSSGGITVYADS-VKG | RRTGIPRRDAFEI |
| M196-G12 | 51.1 | | RASQSISSWLA | KASTLES | QQYNTYWT | NYSMD | RIYSSGGGTIYADS-VKG | RRTGIPRRDAFDI |
| M195-F12 | 45.5 | | RASQSISSWLA | KASTLES | QQYNTYWT | HYVMM | YIVPSGGVTAYADS-VKG | RRTGIPRRDAFDI |
| M200-B01 | 42.6 | | RASQSISSWLA | KASTLES | QQYNTYWT | HYIMM | GIYSSGGITVYADS-VKG | RRTGIPRRDAFDS |
| M198-H09 | 41.1 | | RASQSISSWLA | KASTLES | QQYNTYWT | IYLMI | YIGPSGGPTEYADS-VKG | RRTGIPRRDAFDI |
| M195-E12 | 38.0 | | RASQSISSWLA | KASTLES | QQYNTYWT | YYIMF | YISPSGGYTHYADS-VKG | RRTGIPRRDAFDI |
| M201-A06 | 36.8 | | RASQSISSWLA | KASTLES | QQYNTYWT | HYIMM | GIYSSGGITVYADS-VKG | RRTGIPRRDVFDI |
| M202-A10 | 36.3 | | RASQSISSWLA | KASTLES | QQYNTYWT | HYIMM | GIYSSGGITVYADS-VKG | RRTGIPRRDSFDI |
| M197-G11 | 19.2 | | RASQSISSWLA | KASTLES | QQYNTYWT | TYAMV | SIYPSGGITTYADS-VKG | RRTGIPRRDAFDI |
| M201-F11 | 15.7 | | RASQSISSWLA | KASTLES | QQYNTYWT | HYIMM | GIYSSGGITVYADS-VKG | RRSGIPRRDAFDI |
| M198-A01 | 13.8 | | RASQSISSWLA | KASTLES | QQYNTYWT | PYTMI | SISSSGGMTPYADS-VKG | RRTGIPRRDAFDI |

Amino acid sequences of light chain (LC) and heavy chain (HC) variable domain of pKal antibodies obtained from CDR1/2 and CDR3 spiking affinity maturation libraries based on M162-A04 (SEQ ID NOS 1640-1803, respectively, in order of appearance).

```
M195-A02               LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-A02               HC
EVQLLESGGG LVQPGGSLRL SCAASGFTFS QYMMMWVRQA PGKGLEWVSG ISSSGGHTDY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-A12               LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-A12               HC
EVQLLESGGG LVQPGGSLRL SCAASGFTFS PYMMMWVRQA PGKGLEWVSG IYPSGGYTVY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-B02               LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

-continued

```
M195-B02              HC
EVQLLESGGG LVQPGGSLRL SCAASGFTFS PYLMWWVRQA PGKGLEWVSY IGPSGGPTHY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-B12              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-B12              HC
EVQLLESGGG LVQPGGSLRL SCAASGFTFS KYWMYWVRQA PGKGLEWVSY IRPSGGQTYY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-C12              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-C12              HC
EVQLLESGGG LVQPGGSLRL SCAASGFTFS MYQMFWVRQA PGKGLEWVSS ISPGGGTQYA    60
DSVKGRFTIS RDNSKNTLYL QMNSLRAEDT AVYYCAYRRT GIPRRDAFDI WGQGTMVTVS   120
SASTKGPSVF PLAPSSKS                                                 138

M195-D12              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-D12              HC
EVQLLESGGG LVQPGGSLRL SCAASGFTFS IYGMFWVRQA PGKGLEWVSG IGPSGGPTKY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-E12              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-E12              HC
EVQLLESGGG LVQPGGSLRL SCAASGFTFS YYIMFWVRQA PGKGLEWVSY ISPSGGYTHY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M195-F12              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-F12              HC
EVQLLESGGG LVQPGGSLRL SCAASGFTFS HYVMMWVRQA PGKGLEWVSY IVPSGGVTAY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M0195-G02             LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M195-G02              HC
EVQLLESGGG LVQPGGSLRL SCAASGFTFS PYNMMWVRQA PGKGLEWVSS IWPSGGTTDY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M196-006              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M196-006              HC
EVQLLESGGG LVQPGGSLRL SCAASGFTFS IYSMHWVRQA PGKGLEWVSS IYPSRGMTWY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M196-D02              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M196-D02              HC
EVQLLESGGG LVQPGGSLRL SCAASGFTFS VYSMHWVRQA PGKGLEWVSV IGPSGGITLY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M196-D12              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

```
M196-D12              HC
EVQLLESGGG LVQPGGSLRL SCAASGFTFS RYSMRWVRQA PGKGLEWVSV IYPSGGQTYY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M196-G12              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M196-G12              HC
EVQLLESGGG LVQPGGSLRL SCAASGFTFS NYSMDWVRQA PGKGLEWVSR IYSSGGGTIY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M196-H03              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M196-H03              HC
EVQLLESGGG LVQPGGSLRL SCAASGFTFS RYVMWWVRQA PGKGLEWVSS ISPSGDTHYA    60
DSVKGRFTIS RDNSKNTLYL QMNSLRAEDT AVYYCAYRRT GIPRRDAFDI WGQGTMVTVS   120
SASTKGPSVF PLAPSSKS                                                 138

M197-A01              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-A01              HC
EVQLLESGGG LVQPGGSLRL SCAASGFTFS IYDMIWVRQA PGKGLEWVSS IYPSGGNTSY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-A08              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-A08              HC
EVQLLESGGG LVQPGGSLRL SCAASGFTFS IYSMQWVRQA PGKGLEWVSS IGSSGGKTLY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-A09              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-A09              HC
EVQLLESGGG LVQPGGSLRL SCAASGFTFS VYNMHWVRQA PGKGLEWVSS IYPSGGMTTY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-C12              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-C12              HC
EVQLLESGGG LVQPGGSLRL SCAASGFTFS PYDMLWVRQA PGKGLEWVSY IVSSGGLTKY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-E12              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-E12              HC
EVQLLESGGG LVQPGGSLRL SCAASGFTFS TYTMRWVRQA PGKGLEWVSS IYPSGGKTQY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-F01              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-F01              HC
EVQLLESGGG LVQPGGSLRL SCAASGFTFS IYHMYWVRQA PGKGLEWVSS IGPSGGPTGY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-F03              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

```
M197-F03                   HC
EVQLLESGGG LVQPGGSLRL SCAASGFTFS IYSMFWVRQA PGKGLEWVSS IGPSGGVTHY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-G10                   LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-G10                   HC
EVQLLESGGG LVQPGGSLRL SCAASGFTFS VYAMRWVRQA PGKGLEWVSS IYPSGGKTWY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-G11                   LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-G11                   HC
EVQLLESGGG LVQPGGSLRL SCAASGFTFS TYAMVWVRQA PGKGLEWVSS IYPSGGITTY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-H10                   LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M197-H10                   HC
EVQLLESGGG LVQPGGSLRL SCAASGFTFS SYNMHWVRQA PGKGLEWVSS IVPSGGKTNY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M197-H11                   LC
QDIQMTQSPS TLSASVGDRV TITCRASQSIS SWLAWYQQK PGKAPNLLIY KASTLESGVP    60
SRFSGSGSGT EFTLTISSLQ PDDFATYYCQQ YNTYWTFGQ GTKVEIK                 107

M197-H11                   HC
EVQLLESGGG LVQPGGSLRL SCAASGFTFSI YNMIWVRQA PGKGLEWVSS IYPSGGWTTY    60
ADSVKGRFTI SRDNSKNTLY LQMNSLRAEDT AVYYCAYRR TGIPRRDAFD IWGQGTMVTV   120
SSASTKGPSV FPLAPSSKS                                                139

M198-A01                   LC
QDIQMTQSPS TLSASVGDRV TITCRASQSIS SWLAWYQQK PGKAPNLLIY KASTLESGVP    60
SRFSGSGSGT EFTLTISSLQ PDDFATYYCQQ YNTYWTFGQ GTKVEIK                 107

M198-A01                   HC
EVQLLESGGG LVQPGGSLRL SCAASGFTFSP YTMIWVRQA PGKGLEWVSS ISSSGGMTPY    60
ADSVKGRFTI SRDNSKNTLY LQMNSLRAEDT AVYYCAYRR TGIPRRDAFD IWGQGTMVTV   120
SSASTKGPSV FPLAPSSKS                                                139

M198-A02                   LC
QDIQMTQSPS TLSASVGDRV TITCRASQSIS SWLAWYQQK PGKAPNLLIY KASTLESGVP    60
SRFSGSGSGT EFTLTISSLQ PDDFATYYCQQ YNTYWTFGQ GTKVEIK                 107

M198-A02                   HC
EVQLLESGGG LVQPGGSLRL SCAASGFTFSR YSMIWVRQA PGKGLEWVSS IWSSGGATEY    60
ADSVKGRFTI SRDNSKNTLY LQMNSLRAEDT AVYYCAYRR TGIPRRDAFD IWGQGTMVTV   120
SSASTKGPSV FPLAPSSKS                                                139

M198-A06                   LC
QDIQMTQSPS TLSASVGDRV TITCRASQSIS SWLAWYQQK PGKAPNLLIY KASTLESGVP    60
SRFSGSGSGT EFTLTISSLQ PDDFATYYCQQ YNTYWTFGQ GTKVEIK                 107

M198-A06                   HC
EVQLLESGGG LVQPGGSLRL SCAASGFTFSI YSMHWVRQA PGKGLEWVSS IYSSGGPTKY    60
ADSVKGRFTI SRDNSKNTLY LQMNSLRAEDT AVYYCAYRR TGIPRRDAFD IWGQGTMVTV   120
SSASTKGPSV FPLAPSSKS                                                139

M198-A07                   LC
QDIQMTQSPS TLSASVGDRV TITCRASQSIS SWLAWYQQK PGKAPNLLIY KASTLESGVP    60
SRFSGSGSGT EFTLTISSLQ PDDFATYYCQQ YNTYWTFGQ GTKVEIK                 107

M198-A07                   HC
EVQLLESGGG LVQPGGSLRL SCAASGFTFSR YQMHWVRQA PGKGLEWVSW ISPSGGITGY    60
ADSVKGRFTI SRDNSKNTLY LQMNSLRAEDT AVYYCAYRR TGIPRRDAFD IWGQGTMVTV   120
SSASTKGPSV FPLAPSSKS                                                139

M198-A08                   LC
QDIQMTQSPS TLSASVGDRV TITCRASQSIS SWLAWYQQK PGKAPNLLIY KASTLESGVP    60
SRFSGSGSGT EFTLTISSLQ PDDFATYYCQQ YNTYWTFGQ GTKVEIK                 107
```

```
M198-A08              HC
EVQLLESGGG LVQPGGSLRL SCAASGFTFSW YMMQWVRQA PGKGLEWVSR ISPSGGTTYA    60
DSVKGRFTIS RDNSKNTLYL QMNSLRAEDTA VYYCAYRRT GIPRRDAFDI WGQGTMVTVS   120
SASTKGPSVF PLAPSSKS                                                 138

M198-A09              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-A09              HC
EVQLLESGGG LVQPGGSLRL SCAASGFTFS IYFMSWVRQA PGKGLEWVSS IRSSGGPTWY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-B09              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-B09              HC
EVQLLESGGG LVQPGGSLRL SCAASGFTFS VYSMTWVRQA PGKGLEWVSS IGSSGGSTTY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-B12              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-B12              HC
EVQLLESGGG LVQPGGSLRL SCAASGFTFS KYSMAWVRQA PGKGLEWVSG IYPSGGRTLY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-C03              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-C03              HC
EVQLLESGGG LVQPGGSLRL SCAASGFTFS RYSMSWVRQA PGKGLEWVSG ISPSGGETSY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-C05              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-C05              HC
EVQLLESGGG LVQPGGSLRL SCAASGFTFS RYKMYWVRQA PGKGLEWVSV IGPSGGATFY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-C06              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-C06              HC
EVQLLESGGG LVQPGGSLRL SCAASGFTFS QYFMHWVRQA PGKGLEWVSY IYPSGGMTEY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-C09              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-C09              HC
EVQLLESGGG LVQPGGSLRL SCAASGFTFS IYTMYWVRQA PGKGLEWVSS ISPSGGWTYY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-C10              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-C10              HC
EVQLLESGGG LVQPGGSLRL SCAASGFTFS HYMGMNWVRQ APGKGLEWVS SIVPSGGWTQ    60
YADSVKGRFT ISRDNSKNTL YLQMNSLRAE DTAVYYCAYR RTGIPRRDAF DIWGQGTMVT   120
VSSASTKGPS VFPLAPSSKS                                               140

M198-D12              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

```
M198-D12                  HC
EVQLLESGGG LVQPGGSLRL SCAASGFTFS LYVMYWVRQA PGKGLEWVSY IVPSGGPTAY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-E02                  LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-E02                  HC
EVQLLESGGG LVQPGGSLRL SCAASGFTFS IYSMYWVRQA PGKGLEWVSY IRPSGGNTKY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-E09                  LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-E09                  HC
EVQLLESGGG LVQPGGSLRL SCAASGFTFS IYDMNWVRQA PGKGLEWVSS IYPSGGRTRY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-E11                  LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-E11                  HC
EVQLLESGGG LVQPGGSLRL SCAASGFTFS TYSMYWVRQA PGKGLEWVSS IYPSGGLTWY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-F04                  LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-F04                  HC
EVQLLESGGG LVQPGGSLRL SCAASGFTFS IYDMWWVRQA PGKGLEWVSS IRPSGGITKY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-F08                  LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-F08                  HC
EVQLLESGGG LVQPGGSLRL SCAASGFTFS VYSMWWVRQA PGKGLEWVSS ISSSGGMTEY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-F09                  LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-F09                  HC
EVQLLESGGG LVQPGGSLRL SCAASGFTFS VYNMHWVRQA PGKGLEWVSS IYPSGGMTYY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-F12                  LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-F12                  HC
EVQLLESGGG LVQPGGSLRL SCAASGFTFS IYTMMWVRQA PGKGLEWVSS IWSSGGQTKY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-G03                  LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-G03                  HC
EVQLLESGGG LVQPGGSLRL SCAASGFTFS QYTMVWVRQA PGKGLEWVSW IYSSRANYAD    60
SVKGRFTISR DNSKNTLYLQ MNSLRAEDTA VYYCAYRRTG IPRRDAFDIW GQGTMVTVSS  120
ASTKGPSVFP LAPSSKS                                                  137

M198-G07                  LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

-continued

```
M198-G07              HC
EVQLLESGGG LVQPGGSLRL SCAASGFTFS IYDMTWVRQA PGKGLEWVSS IYPSGGQTIY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-H02              LC
QDIQMTQSPS TLSASVGDRV TITCRASQSI SSWLAWYQQK PGKAPNLLIYK ASTLESGVP    60
SRFSGSGSGT EFTLTISSLQ PDDFATYYCQ QYNTYWTFGQ GTKVEIK                 107

M198-H02              HC
EVQLLESGGG LVQPGGSLRL SCAASGFTFS PYNMYWVRQA PGKGLEWVSW IVPGGVTKYA    60
DSVKGRFTIS RDNSKNTLYL QMNSLRAEDT AVYYCAYRRT GIPRRDAFDI WGQGTMVTVS   120
SASTKGPSVF PLAPSSKS                                                 138

M198-H08              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-H08              HC
EVQLLESGGG LVQPGGSLRL SCAASGFTFS IYDMYWVRQA PGKGLEWVSS IGPSGGPTAY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M198-H09              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M198-H09              HC
EVQLLESGGG LVQPGGSLRL SCAASGFTFS IYLMIWVRQA PGKGLEWVSY IGPSGGPTEY    60
ADSVKGRFTI SRDNSKNTLY LQMNSLRAED TAVYYCAYRR TGIPRRDAFD IWGQGTMVTV   120
SSASTKGPSV FPLAPSSKS                                                139

M199-A08              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M199-A08              HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR IGVPRRDEFD IWGQGTMVTV   120
SSASTKGPSV FPLAPSSKS                                                139

M199-A11              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M199-A11              HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR RGIPRRDAFD IWGQGTMVTV   120
SSASTKGPSV FPLAPSSKS                                                139

M199-B01              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M199-B01              HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAFRR TGIPRRDAFD NWGQGTMVTV   120
SSASTKGPSV FPLAPSSKS                                                139

M200-A10              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M200-A10              HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRDSFD IWGQGTMVTV   120
SSASTKGPSV FPLAPSSKS                                                139

M200-B01              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M200-B01              HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGIPRRDAFD SWGQGTMVTV   120
SSASTKGPSV FPLAPSSKS                                                139

M200-D03              LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

```
-continued
M200-D03            HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAWRR IGVPRRDSFD MWGQGTMVTV   120
SSASTKGPSV FPLAPSSKS                                                139

M200-E11            LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M200-E11            HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRDAFD NWGQGTMVTV   120
SSASTKGPSV FPLAPSSKS                                                139

M200-F01            LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M200-F01            HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR MGIPRRNAFD IWGQGTMVTV   120
SSASTKGPSV FPLAPSSKS                                                139

M200-H07            LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M200-H07            HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRNAFD NWGQGTMVTV   120
SSASTKGPSV FPLAPSSKS                                                139

M201-A06            LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M201-A06            HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGIPRRDVFD IWGQGTMVTV   120
SSASTKGPSV FPLAPSSKS                                                139

M201-A07            LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M201-A07            HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRDEFD IWGQGTMVTV   120
SSASTKGPSV FPLAPSSKS                                                139

M201-F11            LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M201-F11            HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR SGIPRRDAFD IWGQGTMVTV   120
SSASTKGPSV FPLAPSSKS                                                139

M201-H06            LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M201-H06            HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRDAFD IWGQGTMVTV   120
SSASTKGPSV FPLAPSSKS                                                139

M201-H08            LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107

M201-H08            HC
EVQLLESGGG LVQPGGSLRL SCAASGFTFS HYIMMWVRQA PGKGLEWVSG IYSSGGITVY    60
ADSVKGRFTI SRDNSKNTLY LQMNSLRAED TAVYYCAYRR TGVPRRDALD NWGQGTMVTV   120
SSASTKGPSV FPLAPSSKS                                                139

M202-A01            LC
QDIQMTQSPS TLSASVGDRV TITCRASQSI SSWLAWYQQK PGKAPNLLIY KASTLESGVP    60
SRFSGSGSGT EFTLTISSLQ PDDFATYYCQ QYNTYWTFGQ GTKVEIK                 107
```

-continued

```
M202-A01                   HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR IGVPRRDAFD IWGQGTMVTV  120
SSASTKGPSV FPLAPSSKS                                               139

M202-A04                   LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-A04                   HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR KGIPRRDDFD IWGQGTMVTV  120
SSASTKGPSV FPLAPSSKS                                               139

M202-A08                   LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-A08                   HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR TGIPRWDAFD IWGQGTMVTV  120
SSASTKGPSV FPLAPSSKS                                               139

M202-A10                   LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-A10                   HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAFRR TGIPRRDSFD IWGQGTMVTV  120
SSASTKGPSV FPLAPSSKS                                               139

M202-A12                   LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-A12                   HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYQR TGVPRRDSFN IWGQGTMVTV  120
SSASTKGPSV FPLAPSSKS                                               139

M202-B03                   LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-B03                   HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR TGVPRRDDFD IWGQGTMVTV  120
SSASTKGPSV FPLAPSSKS                                               139

M202-B04                   LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-B04                   HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR SGVPRRDDFD IWGQGTMVTV  120
SSASTKGPSV FPLAPSSKS                                               139

M202-C01                   LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-C01                   HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR TGVPRWDDFD IWGQGTMVTV  120
SSASTKGPSV FPLAPSSKS                                               139

M202-C02                   LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-C02                   HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR PGVPRRDAFD IWGQGTMVTV  120
SSASTKGPSV FPLAPSSKS                                               139

M202-009                   LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107
```

-continued

```
M202-009              HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR IGVPRRDDFD IWGQGTMVTV  120
SSASTKGPSV FPLAPSSKS                                              139

M202-D09              LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-D09              HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR IGVPRRDSFD IWGQGTMVTV  120
SSASTKGPSV FPLAPSSKS                                              139

M202-E03              LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-E03              HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR TGIPRRDAFE IWGQGTMVTV  120
SSASTKGPSV FPLAPSSKS                                              139

M202-E06              LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-E06              HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR RGVPRRDDFD IWGQGTMVTV  120
SSASTKGPSV FPLAPSSKS                                              139

M202-F06              LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-F06              HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAYRR TGVPRWDAFD IWGQGTMVTV  120
SSASTKGPSV FPLAPSSKS                                              139

M202-G03              LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-G03              HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAFRR TGVPRRDSFE IWGQGTMVTV  120
SSASTKGPSV FPLAPSSKS                                              139

M202-H03              LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-H03              HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAFRR TGVPRWDDFD IWGQGTMVTV  120
SSASTKGPSV FPLAPSSKS                                              139

M202-H05              LC
QDIQMTQSPS TLSASVGDRV TITCRASQSI SSWLAWYQQK PGKAPNLLIY KASTLESGVP   60
SRFSGSGSGT EFTLTISSLQ PDDFATYYCQ QYNTYWTFGQ GTKVEIK                107

M202-H05              HC
EVQLLESGGG LVQPGGSLRL SCAASGFTFS HYIMMWVRQA PGKGLEWVSG IYSSGGITVY   60
ADSVKGRFTI SRDNSKNTLY LQMNSLRAED TAVYYCAFRR TGVPRRDVFD IWGQGTMVTV  120
SSASTKGPSV FPLAPSSKS                                              139
```

TABLE 9

Sequences of Antibodies Obtained from CDR1/2 and CDR3 Spiking Affinity Maturation Libraries Based on X63-G06
(SEQ ID NOS 1804-2175, respectively, in order of appearance)

| Antibody I.D. | % inhibition at 10 nM | human pKal Ki, app (nM) | LV-CDR1 | LV-CDR2 | LV-CDR3 | HV-CDR1 | HV-CDR2 | HV-CDR3 |
|---|---|---|---|---|---|---|---|---|
| M209-97.6 F04 | | 0.09 | RTSQFVNSNYLA | GASSRAT | QQSSRTPWT | HYLMT | YISPSGGHTIYADSVKG | VARGIAARSRTSYLDq |
| M209-96.2 C11 | | 0.14 | RTSQFVNSNYLA | GASSRAT | QQSSRTPWT | HYLMT | YISPSGGHTIYADSVKG | VGQGIRGRSRTSYFAq |
| M206-96.0 H08 | | 0.17 | RTSQFVNSNYLA | GASSRAT | QQSSRTPWT | DYMMA | SIVPSGGHTHYADSVKG | VARGIAARSRTSYFDY |
| M210-95.6 C12 | | 0.16 | RTSQFVNSNYLA | GASSRAT | QQSSRTPWT | HYLMT | YISPSGGHTIYADSVKG | VAQGIAARSRTSSVDq |
| M208-95.4 F04 | | 0.2 | RTSQFVNSNYLA | GASSRAT | QQSSRTPWT | HYLMT | YISPSGGHTIYADSVKG | VARGIAARSRTSFFDY |
| M206-94.7 B10 | | 0.3 | RTSQFVNSNYLA | GASSRAT | QQSSRTPWT | qYLMA | SIYPSGGWTKYADSVKG | VARGIAARSRTSYFDY |
| M208-94.4 H02 | | 0.2 | RTSQFVNSNYLA | GASSRAT | QQSSRTPWT | HYLMT | YISPSGGHTIYADSVKG | VARGIASRSRTRYCDY |
| M210-94.2 G04 | | 0.3 | RTSQFVNSNYLA | GASSRAT | QQSSRTPWT | HYLMT | YISPSGGHTIYADSVKG | VATGIVARSRTRYFDq |
| M210-93.8 H06 | | 0.2 | RTSQFVNSNYLA | GASSRAT | QQSSRTPWT | HYLMT | YISPSGGHTIYADSVKG | VARGIAARSRTRYFDY |
| M208-93.7 E10 | | 0.09 | RTSQFVNSNYLA | GASSRAT | QQSSRTPWT | HYLMT | YISPSGGHTIYADSVKG | VAQGISARSRTSYFDY |
| M209-93.5 B09 | | 0.2 | RTSQFVNSNYLA | GASSRAT | QQSSRTPWT | HYLMT | YISPSGGHTIYADSVKG | VAQGIVARSRTSYLHq |
| M209-93.4 C12 | | | RTSQFVNSNYLA | GASSRAT | QQSSRTPWT | HYLMT | YISPSGGHTIYADSVKG | VGRGIAARSRTSqLDY |
| M208-93.4 G03 | | 0.3 | RTSQFVNSNYLA | GASSRAT | QQSSRTPWT | HYLMT | YISPSGGHTIYADSVKG | VARGIAARSRTSYLDY |
| M206-93.0 A06 | | | RTSQFVNSNYLA | GASSRAT | QQSSRTPWT | NYMMG | SISPSGGLTKYADSVKG | VARGIAARSRTSYFDY |
| M210-92.8 H07 | | 0.4 | RTSQFVNSNYLA | GASSRAT | QQSSRTPWT | HYLMT | YISPSGGHTIYADSVKG | VARGIAARSRTRYFDq |
| M206-92.6 F01 | | 0.2 | RTSQFVNSNYLA | GASSRAT | QQSSRTPWT | GYMMV | RISPSGGPTIYADSVKG | VARGIAARSRTSYFDY |
| M208-92.5 F10 | | 0.2 | RTSQFVNSNYLA | GASSRAT | QQSSRTPWT | HYLMT | YISPSGGHTIYADSVKG | VARGIAARSRTSYFDq |
| M209-92.4 E02 | | 0.3 | RTSQFVNSNYLA | GASSRAT | QQSSRTPWT | HYLMT | YISPSGGHTIYADSVKG | VARGIAARSRTILLDq |
| M208-91.7 C06 | | 0.4 | RTSQFVNSNYLA | GASSRAT | QQSSRTPWT | HYLMT | YISPSGGHTIYADSVKG | VARGIAARSRTSFIDY |
| M205-91.5 D04 | | 0.4 | RTSQFVNSNYLA | GASSRAT | QQSSRTPWT | TYKMq | SISPSGGPTNYADSVKG | VARGIAARSRTSYFDY |
| M210-91.2 G10 | | 0.4 | RTSQFVNSNYLA | GASSRAT | QQSSRTPWT | HYLMT | YISPSGGHTIYADSVKG | VARGIAARSRTSYLDF |
| M207-90.9 A04 | | | RTSQFVNSNYLA | GASSRAT | QQSSRTPWT | HYLMT | YISPSGGHTIYADSVKG | VARGIAARSRTRSFDY |
| M210-90.9 B02 | | 0.2 | RTSQFVNSNYLA | GASSRAT | QQSSRTPWT | HYLMT | YISPSGGHTIYADSVKG | VARGIAARSRTSYFNq |

TABLE 9-continued

Sequences of Antibodies Obtained from CDR1/2 and CDR3 Spiking Affinity Maturation
Libraries Based on X63-G06
(SEQ ID NOS 1804-2175, respectively, in order of appearance)

| Antibody I.D. | % inhibition at 10 nM | human pKal Ki, app (nM) | LV-CDR1 | LV-CDR2 | LV-CDR3 | HV-CDR1 | HV-CDR2 | HV-CDR3 |
|---|---|---|---|---|---|---|---|---|
| M208-90.1 B01 | | | RTSQFVNSNYLA | GASSRAT | QQSSRTPWT | HYLMT | YISPSGGHTIYADSVKG | VARGIAARSRTSFFDq |
| M209-89.8 G07 | | | RTSQFVNSNYLA | GASSRAT | QQSSRTPWT | HYLMT | YISPSGGHTIYADSVKG | VARGIAARSRTSYFDT |
| M204-89.5 A02 | | | RTSQFVNSNYLA | GASSRAT | QQSSRTPWT | DYMMT | YISPSGGLTSYADSVKG | VARGIAARSRTSYFDY |
| M206-87.6 H01 | | | RTSQFVNSNYLA | GASSRAT | QQSSRTPWT | EYMMV | RISPSGGTTEYADSVKG | VARGIAARSRTSYFDY |
| M209-87.3 B11 | | | RTSQFVNSNYLA | GASSRAT | QQSSRTPWT | HYLMT | YISPSGGHTIYADSVKG | VARGIAARSRTRYIDq |
| M206-86.8 F09 | | | RTSQFVNSNYLA | GASSRAT | QQSSRTPWT | VYMMS | SIVPSGGSTTYADSVKG | VARGIAARSRTSYFDY |
| M209-86.8 C02 | | | RTSQFVNSNYLA | GASSRAT | QQSSRTPWT | HYLMT | YISPSGGHTIYADSVKG | VARGIAYRRRTSYFDY |
| M208-86.7 G02 | | | RTSQFVNSNYLA | GASSRAT | QQSSRTPWT | HYLMT | YISPSGGHTIYADSVKG | VARGIADRSRTSYSDY |
| M205-86.5 C11 | | | RTSQFVNSNYLA | GASSRAT | QQSSRTPWT | QYMMM | RISPSGGSTLYADSVKG | VARGIAARSRTSYFDY |
| M205-85.9 H08 | | | RTSQFVNSNYLA | GASSRAT | QQSSRTPWT | DYMMM | SIVPSGGHTqYADSVKG | VARGIAARSRTSYFDY |
| M210-85.5 H01 | | | RTSQFVNSNYLA | GASSRAT | QQSSRTPWT | HYLMT | YISPSGGHTIYADSVKG | VARGIAARSRNSqQDY |
| M209-85.4 D12 | | | RTSQFVNSNYLA | GASSRAT | QQSSRTPWT | HYLMT | YISPSGGHTIYADSVKG | VARGIAARSRTSYFDq |
| M209-85.3 H09 | | | RTSQFVNSNYLA | GASSRAT | QQSSRTPWT | HYLMT | YISPSGGHTIYADSVKG | VARGIAARSRTVYFDH |
| M204-84.1 E12 | | | RTSQFVNSNYLA | GASSRAT | QQSSRTPWT | TYMMq | YIGPSGGKTDYADSVKG | VARGIAARSRTSYFDY |
| M209-82.6 H03 | | | RTSQFVNSNYLA | GASSRAT | QQSSRTPWT | HYLMT | YISPSGGHTIYADSVKG | VAQGIAARSRTTqFDY |
| M206-82.5 H05 | | | RTSQFVNSNYLA | GASSRAT | QQSSRTPWT | GYKMq | SISPSGGITMYADSVKG | VARGIAARSRTSYFDY |
| M209-80.4 D03 | | | RTSQFVNSNYLA | GASSRAT | QQSSRTPWT | HYLMT | YISPSGGHTIYADSVKG | VGRGIAARSRTSFFDq |
| M205-80.3 A02 | | | RTSQFVNSNYLA | GASSRAT | QQSSRTPWT | TYLMA | GIVSSGGRTLYADSVKG | VARGIAARSRTSYFDY |
| M208-78.5 A10 | | | RTSQFVNSNYLA | GASSRAT | QQSSRTPWT | HYLMT | YISPSGGHTIYADSVKG | VARGIAARSRTSqFDH |
| M205-78.2 E11 | | | RTSQFVNSNYLA | GASSRAT | QQSSRTPWT | NYTMG | SISPSGGKTDYADSVKG | VARGIAARSRTSYFDY |
| M206-77.6 E02 | | | RTSQFVNSNYLA | GASSRAT | QQSSRTPWT | EYMMM | VISPSGGQTHYADSVKG | VARGIAARSRTSYFDY |
| M205-77.1 H01 | | | RTSQFVNSNYLA | GASSRAT | QQSSRTPWT | NYTMQ | YISPSGGYTGYADSVKG | VARGIAARSRTSYFDY |
| M207-76.6 A02 | | | RTSQFVNSNYLA | GASSRAT | QQSSRTPWT | HYLMT | YISPSGGHTIYADSVKG | VARGIAARSRTINLDY |

TABLE 9-continued

Sequences of Antibodies Obtained from CDR1/2 and CDR3 Spiking Affinity Maturation Libraries Based on X63-G06
(SEQ ID NOS 1804-2175, respectively, in order of appearance)

| Antibody I.D. | % inhibition at 10 nM | human pKal Ki, app (nM) | LV-CDR1 | LV-CDR2 | LV-CDR3 | HV-CDR1 | HV-CDR2 | HV-CDR3 |
|---|---|---|---|---|---|---|---|---|
| M209-76.1 H07 | | | RTSQFVNSNYLA | GASSRAT | QQSSRTPWT | HYLMT | YISPSGGHTIYADSVKG | VARGIAARqRTSYYDY |
| M209-74.8 G01 | | | RTSQFVNSNYLA | GASSRAT | QQSSRTPWT | HYLMT | YISPSGGHTIYADSVKG | VAgGISGRSRLSYVDY |
| M210-74.8 A06 | | | RTSQFVNSNYLA | GASSRAT | QQSSRTPWT | HYLMT | YISPSGGHTIYADSVKG | VARGIAARSRTSqFDY |
| M209-74.7 D02 | | | RTSQFVNSNYLA | GASSRAT | QQSSRTPWT | HYLMT | YISPSGGHTIYADSVKG | VARGITARSRTSYFDD |
| M205-71.1 B04 | | | RTSQFVNSNYLA | GASSRAT | QQSSRTPWT | NYDMI | SISSSGGTTKYADSVKG | VARGIAARSRTSYFDY |
| M203-69.1 A03 | | | RTSQFVNSNYLA | GASSRAT | QQSSRTPWT | VYMMI | SISPSGGQTTYADSVKG | VARGIAARSRTSYFDY |
| M209-68.8 E03 | | | RTSQFVNSNYLA | GASSRAT | QQSSRTPWT | HYLMT | YISPSGGHTIYADSVKG | qARGIAARSRTSYFDY |
| M207-67.2 A01 | | | RTSQFVNSNYLA | GASSRAT | QQSSRTPWT | HYLMT | YISPSGGHTIYADSVKG | VARGISARSRTSCFDY |
| M206-65.5 C03 | | | RTSQFVNSNYLA | GASSRAT | QQSSRTPWT | qYMMV | SIYSSGGNTPYADSVKG | VARGIAARSRTSYFDY |
| M207-61.4 C05 | | | RTSQFVNSNYLA | GASSRAT | QQSSRTPWT | HYLMT | YISPSGGHTIYADSVKG | VGRGIAARSRTSYFDK |
| M205-58.8 A12 | | | RTSQFVNSNYLA | GASSRAT | QQSSRTPWT | QYDMI | YISSSGGFTRYADSVKG | VARGIAARSRTSYFDY |
| M205-58.6 F03 | | | RTSQFVNSNYLA | GASSRAT | QQSSRTPWT | SqQMV | YISPSGGNTYYADSVKG | VARGIAARSRTSYFDY |
| M203-51.4 A01 | | | RTSQFVNSNYLA | GASSRAT | QQSSRTPWT | NYLMA | WIVPSGGYTEYADSVKG | VARGIAARSRTSYFDY |
| M209-47.0 B01 | | | RTSQFVNSNYLA | GASSRAT | QQSSRTPWT | HYLMT | YISPSGGHTIYADSVKG | VARGIVARSRTSNFDq |
| M208-43.7 D12 | | | RTSQFVNSNYLA | GASSRAT | QQSSRTPWT | HYLMT | YISPSGGHTIYADSVKG | LARGIAARSRTSYqDI |
| M206-19.0 H04 | | | RTSQFVNSNYLA | GASSRAT | QQSSRTPWT | SYMMV | SISPSGGYTIqADSVKG | VARGIAARSRTSYFDY |

Amino acid sequences of light chain (LC) and heavy chain (HC) variable domain of pKal antibodies obtained from CDR1/2 and CDR3 spiking affinity maturation libraries based on X63-G06 (SEQ ID NOS 2176-2299, respectively, in order of appearance).

```
M203-A01                LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M203-A01                HC
EVQLLESGGG LVQPGGSLRL SCAASGFTFS NYLMAWVRQA PGKGLEWVSW IVPSGGYTEY    60

ADSVKGRFTI SRDNSKNTLY LQMNSLRAED TAVYYCARVA RGIAARSRTS YFDYWGQGTL   120

VTVSSASTKG PSVFPLAPSS KS                                            142
```

```
M203-A03                  LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M203-A03                  HC
EVQLLESGGG LVQPGGSLRL SCAASGFTFS VYMMIWVRQA PGKGLEWVSS ISPSGGQTTY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M204-A02                  LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M204-A02                  HC
EVQLLESGGG LVQPGGSLRL SCAASGFTFS DYMMTWVRQA PGKGLqWVSY ISPSGGLTSY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M204-E12                  LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M204-E12                  HC
EVQLLESGGG LVQPGGSLRL SCAASGFTFS TYMMqWVRQA PGKGLEWVSY IGPSGGKTDY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M205-A02                  LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M205-A02                  HC
EVQLLESGGG LVQPGGSLRL SCAASGFTFS TYLMAWVRQA PGKGLEWVSG IVSSGGRTLY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M205-A12                  LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M205-A12                  HC
EVQLLESGGG LVQPGGSLRL SCAASGFTFS QYDMIWVRQA PGKGLEWVSY ISSSGGFTRY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M205-B04                  LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M205-B04                  HC
EVQLLESGGG LVQPGGSLRL SCAASGFTFS NYDMIWVRQA PGKGLEWVSS ISSSGGTTKY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M205-C11                  LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109
```

```
M205-C11               HC
EVQLLESGGG LVQPGGSLRL SCAASGFTFS QYMMMWVRQA PGKGLEWVSR ISPSGGSTLY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M205-D04               LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK                109

M205-D04               HC
EVQLLESGGG LVQPGGSLRL SCAASGFTFS TYKMqWVRQA PGKGLEWVSS ISPSGGPTNY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M205-E11               LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK                109

M205-E11               HC
EVQLLESGGG LVQPGGSLRL SCAASGFTFS NYTMGWVRQA PGKGLEWVSS ISPSGGKTDY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M205-F03               LC
QDIQMTQSPG TLSLSPGERA TLSCRTSQFV NSNYLAWYQQ TPGQAPRLLIY GASSRATGI    60

PDRFSGTGYG TDFTLTISRL EPEDGTYYC QQSSRTPWTF GQGTRVEIK                109

M205-F03               HC
EVQLLESGGG LVQPGGSLRL SCAASGFTFS SqQMVWVRQA PGKGLEWVSY ISPSGGNTYY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M205-H01               LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK                109

M205-H01               HC
EVQLLESGGG LVQPGGSLRL SCAASGFTFS NYTMQWVRQA PGKGLqWVSY ISPSGGYTGY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M205-H08               LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK                109

M205-H08               HC
EVQLLESGGG LVQPGGSLRL SCAASGFTFS DYMMMWVRQA PGKGLEWVSS IVPSGGHTqY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M206-A06               LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK                109

M206-A06               HC
EVQLLESGGG LVQPGGSLRL SCAASGFTFS NYMMGWVRQA PGKGLqWVSS ISPSGGLTKY    60

ADSVKGRFTI SRDNSKNTLY LQMNSLRAED TAVYYCARVA RGIAARSRTS YFDYWGQGTL   120

VTVSSASTKG PSVFPLAPSS KS                                           142
```

```
M206-B10              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M206-B10              HC
EVQLLESGGG LVQPGGSLRL SCAASGFTFS qYLMAWVRQA PGKGLEWVSS IYPSGGWTKY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M206-C03              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M206-C03              HC
EVQLLESGGG LVQPGGSLRL SCAASGFTFS qYMMVWVRQA PGKGLEWVSS IYSSGGNTPY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M206-E02              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M206-E02              HC
EVQLLESGGG LVQPGGSLRL SCAASGFTFS EYMMMWVRQA PGKGLEWVSV ISPSGGQTHY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M206-F01              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M206-F01              HC
EVQLLESGGG LVQPGGSLRL SCAASGFTFS GYMMVWVRQA PGKGLEWVSR ISPSGGPTIY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M206-F09              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M206-F09              HC
EVQLLESGGG LVQPGGSLRL SCAASGFTFS VYMMSWVRQA PGKGLEWVSS IVPSGGSTTY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M206-H01              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M206-H01              HC
EVQLLESGGG LVQPGGSLRL SCAASGFTFS EYMMVWVRQA PGKGLEWVSR ISPSGGTTEY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M206-H04              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109
```

```
M206-H04              HC
EVQLLESGGG LVQPGGSLRL SCAASGFTFS SYMMVWVRQA PGKGLEWVSS ISPSGGYTIq    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M206-H05              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M206-H05              HC
EVQLLESGGG LVQPGGSLRL SCAASGFTFS GYKMqWVRQA PGKGLEWVSS ISPSGGITMY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M206-H08              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M206-H08              HC
EVQLLESGGG LVQPGGSLRL SCAASGFTFS DYMMAWVRQA PGKGLEWVSS IVPSGGHTHY    60

ADSVKGRFTI SRDNSKNTLY LQMNSLRAED TAVYYCARVA RGIAARSRTS YFDYWGQGTL   120

VTVSSASTKG PSVFPLAPSS KS                                           142

M207-A01              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M207-A01              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGISARSRTS CFDYWGQGTL   120

VTVSSASTKG PSVFPLAPSS KS                                           142

M207-A02              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M207-A02              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TALYYCARVA RGIAARSRTI NLDYWGQGTL   120

VTVSSASTKG PSVFPLAPSS KS                                           142

M207-A04              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M207-A04              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTR SFDYWGQGTL   120

VTVSSASTKG PSVFPLAPSS KS                                           142

M207-C05              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

R0121-D02 = M0207-C05           HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVG RGIAARSRTS YFDKWGQGTL   120

VTVSSASTKG PSVFPLAPSS KS                                           142
```

```
M208-A10              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK              109

M208-A10              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS qFDHWGQGTL  120

VTVSSASTKG PSVFPLAPSS KS                                         142

M208-B01              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK              109

M208-B01              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS FFDqWGQGTL  120

VTVSSASTKG PSVFPLAPSS KS                                         142

M208-C06              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK              109

M208-C06              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS FIDYWGQGTL  120

VTVSSASTKG PSVFPLAPSS KS                                         142

M208-D12              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK              109

M208-D12              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARLA RGIAARSRTS YqDIWGQGTL  120

VTVSSASTKG PSVFPLAPSS KS                                         142

M208-E10              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK              109

M208-E10              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA QGISARSRTS YFDYWGQGTL  120

VTVSSASTKG PSVFPLAPSS KS                                         142

M208-F04              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK              109

M208-F04              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS FFDYWGQGTL  120

VTVSSASTKG PSVFPLAPSS KS                                         142

M208-F10              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK              109
```

```
M208-F10                    HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIAARSRTS YFDqWGQGTL     120

VTVSSASTKG PSVFPLAPSS KS                                              142

M208-G02                    LC
QDIQMTQSPG TLSLSPGERA TLSCRTSQFV NSNYLAWYQQ TPGQAPRLLI YGASSRATGI      60

PDRFSGTGYG TDFTLTISRL EPEDGTYYC QQSSRTPWTF GQGTRVEIK                  109

M208-G02                    HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIADRSRTS YSDYWGQGTL     120

VTVSSASTKG PSVFPLAPSS KS                                              142

M208-G03                    LC
QDIQMTQSPG TLSLSPGERA TLSCRTSQFV NSNYLAWYQQ TPGQAPRLLI YGASSRATGI      60

PDRFSGTGYG TDFTLTISRL EPEDGTYYC QQSSRTPWTF GQGTRVEIK                  109

M208-G03                    HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIAARSRTS YLDYWGQGTL     120

VTVSSASTKG PSVFPLAPSS KS                                              142

M208-H02                    LC
QDIQMTQSPG TLSLSPGERA TLSCRTSQFV NSNYLAWYQQ TPGQAPRLLI YGASSRATGI      60

PDRFSGTGYG TDFTLTISRL EPEDGTYYC QQSSRTPWTF GQGTRVEIK                  109

M208-H02                    HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIASRSRTR YCDYWGQGTL     120

VTVSSASTKG PSVFPLAPSS KS                                              142

M209-B01                    LC
QDIQMTQSPG TLSLSPGERA TLSCRTSQFV NSNYLAWYQQ TPGQAPRLLI YGASSRATGI      60

PDRFSGTGYG TDFTLTISRL EPEDGTYYC QQSSRTPWTF GQGTRVEIK                  109

M209-B01                    HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIVARSRTS NFDqWGQGTL     120

VTVSSASTKG PSVFPLAPSS KS                                              142

M209-B09                    LC
QDIQMTQSPG TLSLSPGERA TLSCRTSQFV NSNYLAWYQQ TPGQAPRLLI YGASSRATGI      60

PDRFSGTGYG TDFTLTISRL EPEDGTYYC QQSSRTPWTF GQGTRVEIK                  109

M209-B09                    HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA QGIVARSRTS YLHqWGQGTL     120

VTVSSASTKG PSVFPLAPSS KS                                              142

M209-B11                    LC
QDIQMTQSPG TLSLSPGERA TLSCRTSQFV NSNYLAWYQQ TPGQAPRLLI YGASSRATGI      60

PDRFSGTGYG TDFTLTISRL EPEDGTYYC QQSSRTPWTF GQGTRVEIK                  109

M209-B11                    HC
EVQLLESGGG LVQPGGSLRL SCAASGFTFS HYLMTWVRQA PGKGLEWVSY ISPSGGHTIY      60

ADSVKGRFTI SRDNSKNTLY LQMNSLRAED TAVYYCARVA RGIAARSRTR YIDqWGQGTL     120

VTVSSASTKG PSVFPLAPSS KS                                              142
```

```
M209-C02            LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK               109

M209-C02            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAYRRRTS YFDYWGQGTL   120

VTVSSASTKG PSVFPLAPSS KS                                           142

M209-C11            LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK               109

M209-C11            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCAMVG QGIRGRSRTS YFAqWGQGTL   120

VTVSSASTKG PSVFPLAPSS KS                                           142

M209-C12            LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK               109

M209-C12            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVG RGIAARSRTS qLDYWGQGTL   120

VTVSSASTKG PSVFPLAPSS KS                                           142

M0209-D02           LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK               109

M209-D02            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGITARSRTS YFDDWGQGTL   120

VTVSSASTKG PSVFPLAPSS KS                                           142

M209-D03            LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK               109

M209-D03            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVG RGIAARSRTS FFDqWGQGTL   120

VTVSSASTKG PSVFPLAPSS KS                                           142

M209-D12            LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK               109

M209-D12            HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCATVA RGIAARSRTS YFDqWGQGTL   120

VTVSSASTKG PSVFPLAPSS KS                                           142

M209-E02            LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK               109
```

```
M209-E02              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTI LLDqWGQGTL   120

VTVSSASTKG PSVFPLAPSS KS                                           142

M209-E03              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK                109

M209-E03              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARqA RGIAARSRTS YFDYWGQGTL   120

VTVSSASTKG PSVFPLAPSS KS                                           142

M209-F04              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK                109

M209-F04              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS YLDqWSQGTL   120

VTVSSASTKG PSVFPLAPSS KS                                           142

M209-G01              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK                109

M209-G01              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA qGISGRSRLS YVDYWGQGTL   120

VTVSSASTKG PSVFPLAPSS KS                                           142

M209-G07              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK                109

M209-G07              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS YFDTWGQGTL   120

VTVSSASTKG PSVFPLAPSS KS                                           142

M209-H03              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK                109

M209-H03              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA QGIAARSRTT qFDYWGQGTL   120

VTVSSASTKG PSVFPLAPSS KS                                           142

M209-H07              LC
QDIQMTQSPG TLSLSPGERA TLSCRTSQFV NSNYLAWYQQ TPGQAPRLLI YGASSRATGI    60

PDRFSGTGYG TDFTLTISRL EPEDGTYYC QQSSRTPWTF GQGTRVEIK                109

M209-H07              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARqRTS YYDYWGQGTL   120

VTVSSASTKG PSVFPLAPSS KS                                           142
```

```
M209-H09               LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M209-H09               HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTV YFDHWGQGTL   120

VTVSSASTKG PSVFPLAPSS KS                                           142

M210-A06               LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M210-A06               HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS qFDYWGQGTL   120

VTVSSASTKG PSVFPLAPSS KS                                           142

M210-B02               LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M210-B02               HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCASVA RGIAARSRTS YFNqWGQGTL   120

VTVSSASTKG PSVFPLAPSS KS                                           142

M210-C12               LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M210-C12               HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA QGIAARSRTS SVDqWGQGTL   120

VTVSSASTKG PSVFPLAPSS KS                                           142

M210-G04               LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M210-G04               HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA TGIVARSRTR YFDqWGQGTL   120

VTVSSASTKG PSVFPLAPSS KS                                           142

M210-G10               LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109

M210-G10               HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTS YLDFWGQGTL   120

VTVSSASTKG PSVFPLAPSS KS                                           142

M210-H01               LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK               109
```

-continued

```
M210-H01              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRNS qQDYWGQGTL   120

VTVSSASTKG PSVFPLAPSS KS                                           142

M210-H06              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M210-H06              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTR YFDYWGQGTL   120

VTVSSASTKG PSVFPLAPSS KS                                           142

M210-H07              LC
QDIQMTQSPG TLSLSPGERA TLSCRTSQFV NSNYLAWYQQ TPGQAPRLLI YGASSRATGI    60

PDRFSGTGYG TDFTLTISRL EPEDYGTYYC QQSSRTPWTF GQGTRVEIK              109

M210-H07              HC
EVQLLESGGG LVQPGGSLRL SCAASGFTFS HYLMTWVRQA PGKGLEWVSY ISPSGGHTIY    60

ADSVKGRFTI SRDNSKNTLY LQMNSLRAED TAVYYCARVA RGIAARSRTR YFDqWGQGTL   120

VTVSSASTKG PSVFPLAPSS KS                                           142
```

Example 6

In Vivo Testing of M162-A04 (IgG) and X101-A01

Figure 2:
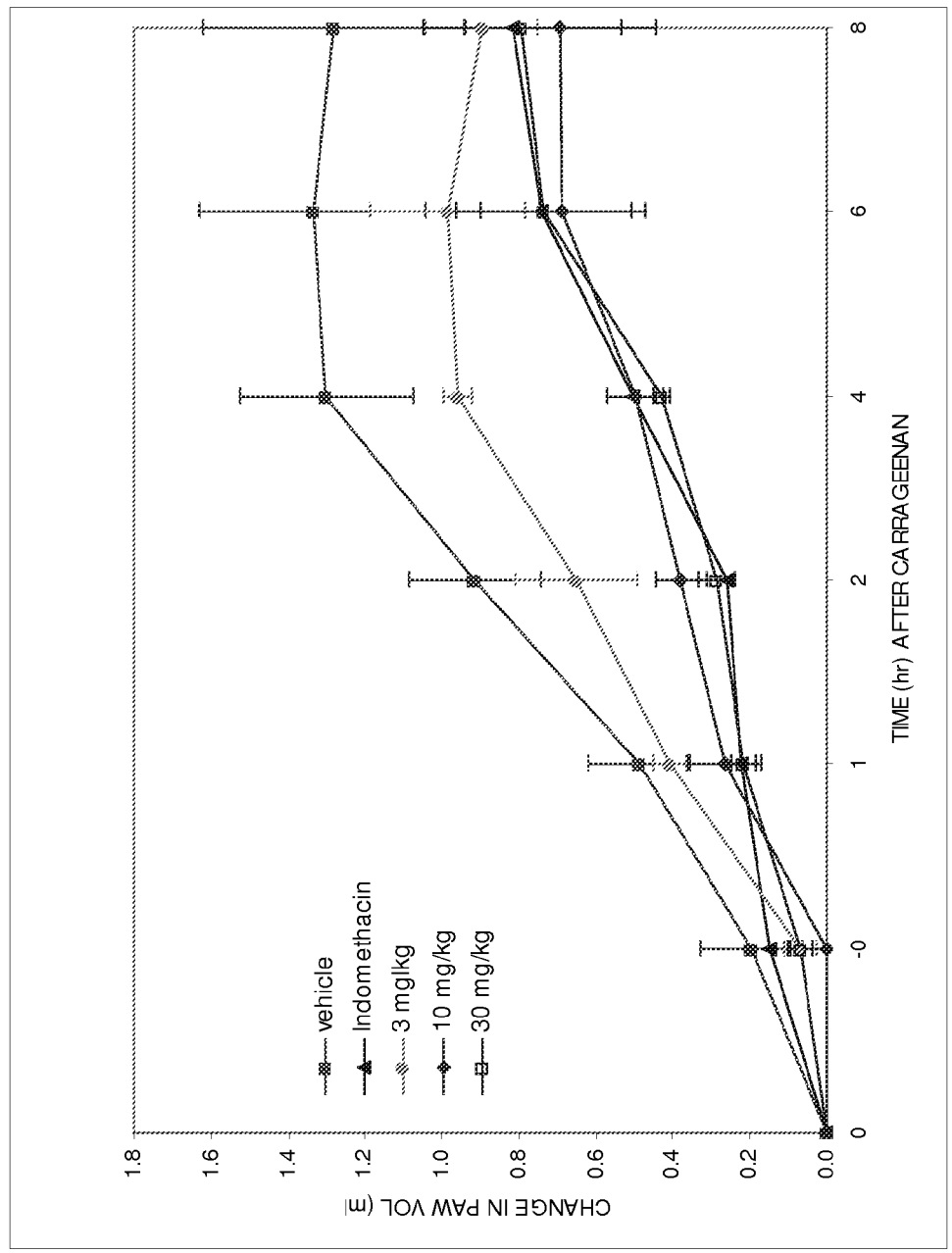
FIG. 2 depicts the effect of M162-A04 on carrageenan-induced rat paw edema. Paw swelling was measured by water displacement.
Figure 3:
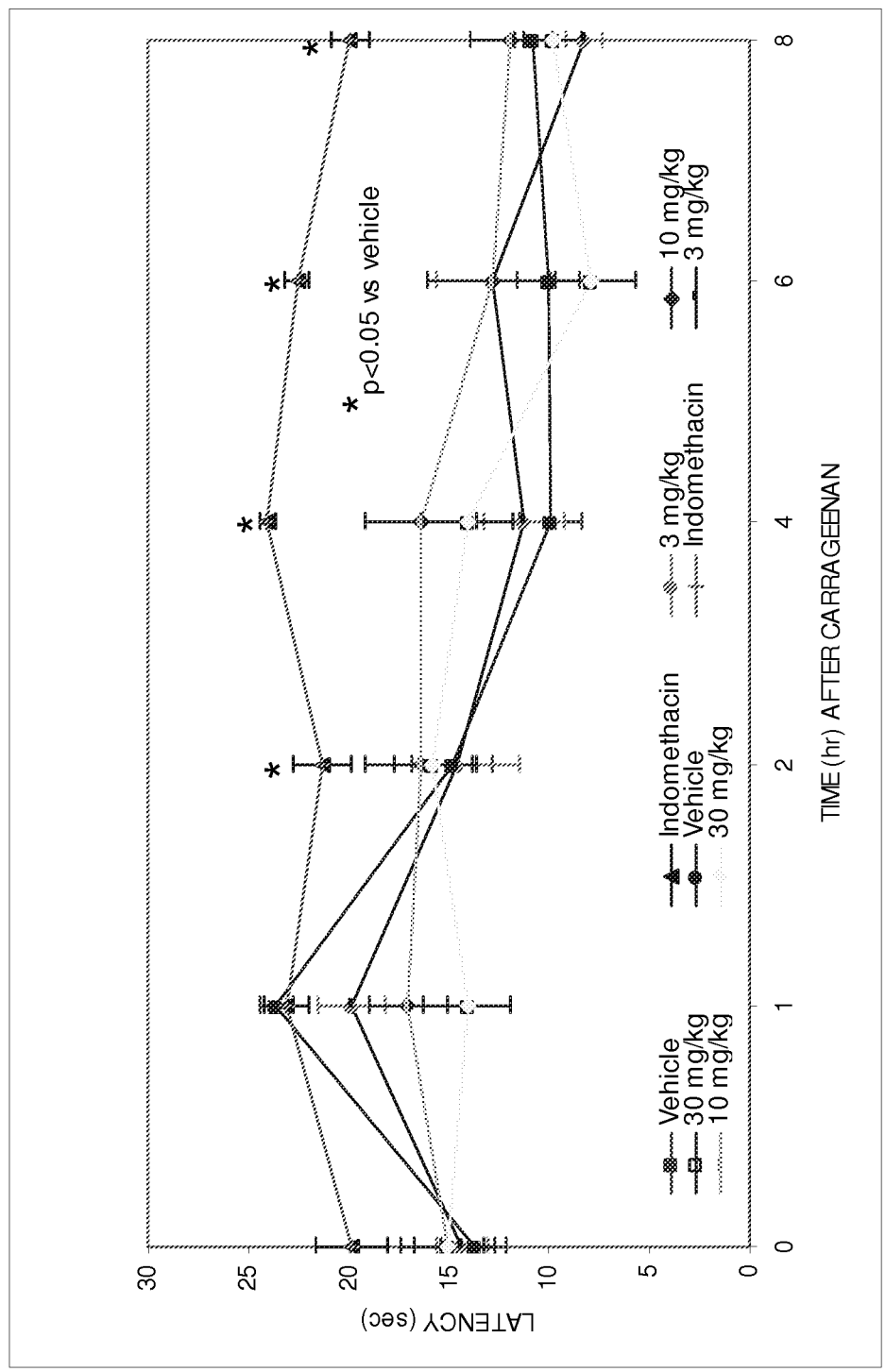
FIG. 3 depicts the effect of M162-A04 on carrageenan-induced thermal hyperalgesia. Pain latency was measured by the Hargreaves method after carrageenan injection.

Bradykinin and other bioactive kinins have been previously implicated in carrageenan-induced edema and inflammatory pain (Sharma J. N. et al. (1998) Inflammopharmacology 6, 9-17; Asano M. et al. (1997) Br J Pharmacol 122, 1436-1440; De Campos R. O. et al. (1996) Eur J Pharmacol 316, 277-286). Plasma kallikrein and tissue kallikrein 1 are the two primary kininogenases in mammals (Schmaier A. H. (2008) Int Immunopharmacol 8, 161-165). M162-A04 (M162-A4) (IgG), a specific plasma kallikrein inhibitor, was tested to determine whether it would be effective in carrageenan induced edema. The study design is outlined in Table 10. The route of administration (ROA) for the vehicle (PBS), the antibody, and the positive control (indomethacin) was intra-peritoneal (IP) and was given 30 minutes prior to carrageenan injection (0.1 mL of a 2% carrageenan solution). It is evident from FIG. 2 that antibody doses at 10 mg/kg and above were equally effective in reducing carrageenan-induced edema as the positive control (indomethacin). However, the antibody was not effective in reducing carrageenan-induced thermal hyperalgesia (FIG. 3). The reason for the dissociation between effectiveness in edema and hyperalgesia are not obvious but may be due to differences in the bioactivity of different kinin metabolites. Lys-desArg9-bradykinin is the most potent agonist of the B1 receptor, which is believed to be primarily involved in pain hypersensitivity (Leeb-Lundberg L. M et al. (2005) Pharmacol Rev 57, 27-77). This kinin metabolite is generated by tissue kallikrein 1, not plasma kallikrein (Schmaier A. H. (2008) Int Immunopharmacol 8, 161-165). This difference in kinin generation and resulting bradykinin receptor activation may account for the unexpected decoupling of edema and hyperalgesia in this model.

Figure 14:
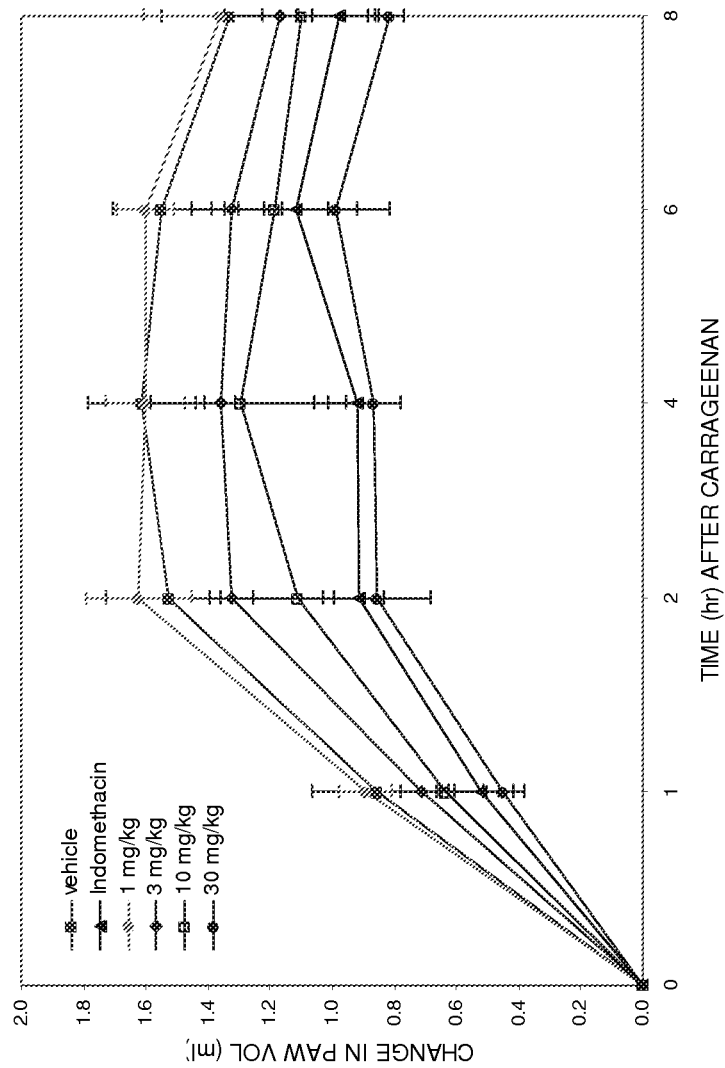
FIG. 14 depicts a graph showing dose dependent inhibition of edema by X101-A01 in carrageenan-induced paw edema (CPE) in rats.
Figure 15:
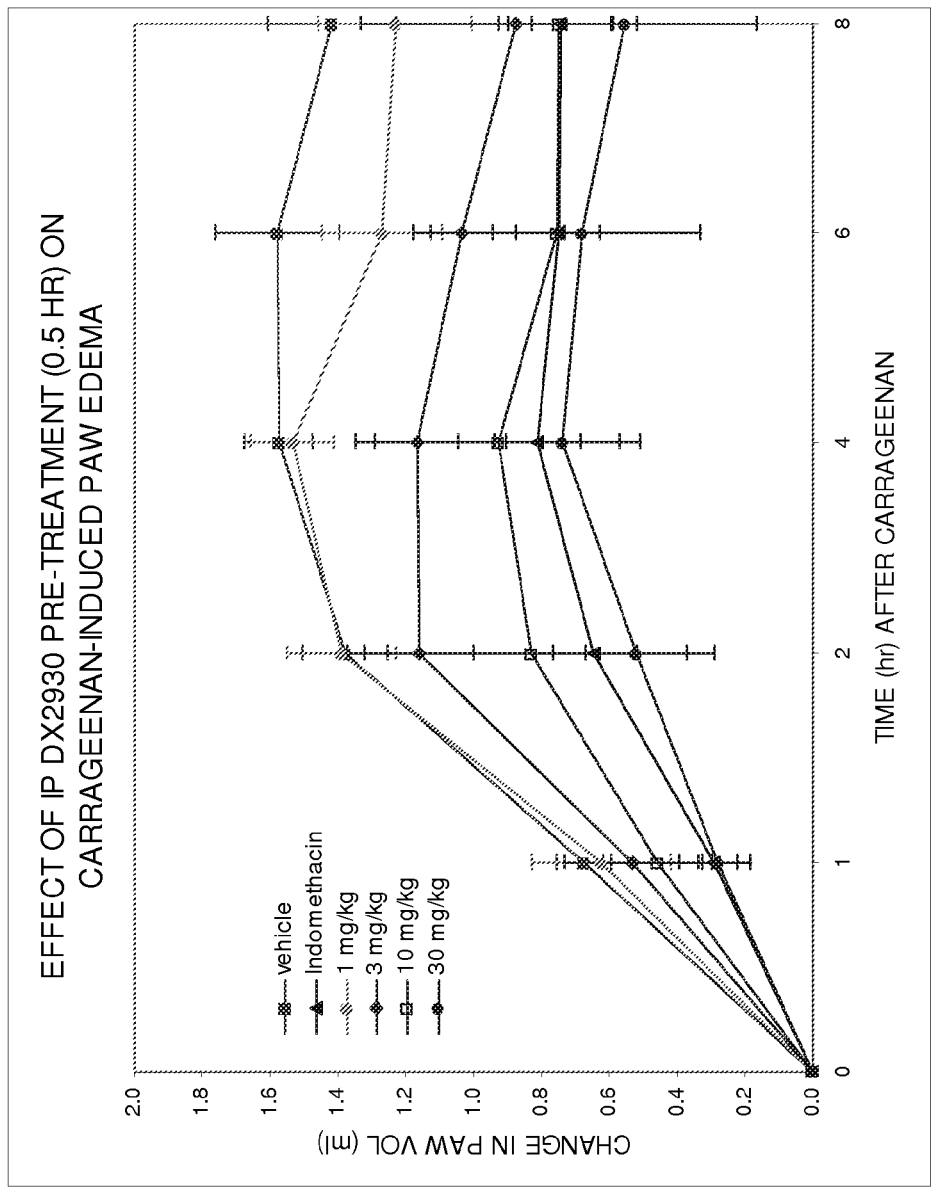
FIG. 15 depicts a graph showing dose dependent inhibition of edema by intraperitoneal administration DX-2930 in carrageenan-induced paw edema in the rat.
Figure 16:
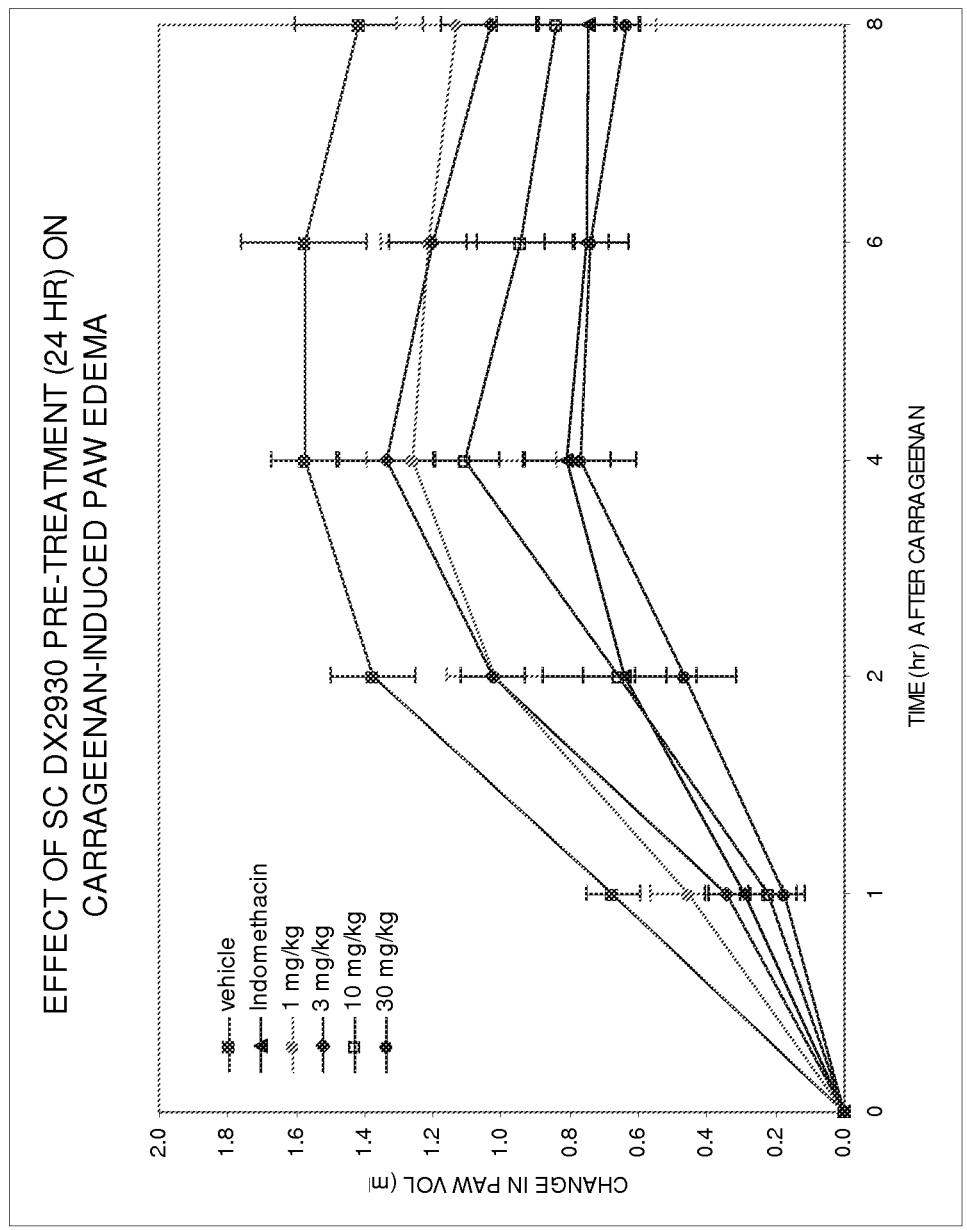
FIG. 16 depicts a graph showing dose dependent inhibition of edema by subcutaneous administration DX-2930 in carrageenan-induced paw edema in the rat.

Another pKal antibody inhibitor X101-A01 was also tested in the CPE model using the study design shown in Table 10B. The data obtained in FIG. 14 shows that X101-A01 inhibited edema in a dose-dependent manner to an extent that is comparable to that of the positive control (indomethacin).

TABLE 10A

Carrageenan-Induced Paw Edema Study Design to test M162-A04

| Group # | Number of Rats | Treatment | Dose (mg/kg) | ROA | Timing relative to carrageenan | Dose Volume (mL/kg) |
|---|---|---|---|---|---|---|
| 1 | 6 | Vehicle | N/A | IP | T −30 minutes | 20 |
| 2 | 6 | 559A-M162-A4 | 3 | IP | T −30 minutes | 20 |
| 3 | 6 | 559A-M162-A4 | 10 | IP | T −30 minutes | 20 |
| 4 | 6 | 559A-M162-A4 | 30 | IP | T −30 minutes | 20 |
| 5 | 6 | Indomethacin | 5 | IP | T −30 minutes | 20 |

TABLE 10B

Carrageenan-Induced Paw Edema Study Design to Test X101-A01

| Group | Treatment | n | Dose (mg/Kg) | ROA | Timing * | Vol (mL/Kg) |
|---|---|---|---|---|---|---|
| 1 | Vehicle | 10 | N/A | IP | −30 min | 20 |
| 2 | X101-A01 | 10 | 1 | IP | −30 min | 20 |
| 3 | X101-A01 | 10 | 3 | IP | −30 min | 20 |
| 4 | X101-A01 | 10 | 10 | IP | −30 min | 20 |
| 5 | X101-A01 | 10 | 30 | IP | −30 min | 20 |
| 6 | Indomethacin | 10 | 5 | IP | −30 min | 20 |

Example 7

Evaluation of Selected Antibody Inhibitors of Plasma Kallikrein

Evaluation of selected optimized antibodies (X81-B01 and X67-D03) is shown in Table 11. Neither antibody has any putative deamidation, isomerization, or oxidation sites.

TABLE 11

| Criteria | X81-B01 (IgG) | X67-D03 (IgG) |
|---|---|---|
| < nM Ki, app against human pKal | 0.2 nM | 0.1 nM |
| < nM Ki, app against rodent pKal | mouse - 11 pM<br>rat - 0.14 nM | mouse - 0.7 nM<br>rat - 0.34 nM |
| prekallikrein binding | no | no |
| Specific inhibitor with respect to fXIa, plasmin, and trypsin | yes | yes |
| Inhibits bradykinin generation | yes | yes |
| Inhibits pKal in presence of prekallikrein | yes | yes |
| Competition for binding with aprotinin | yes | yes |
| Stability in human serum | yes | nd* |

*not done; a parental form of this antibody was shown to be stable in serum

Example 8

Epitope Mapping

The region of pKal bound by selected anti-pKal antibodies was investigated using several methods. First, competition assays were used to determine whether the antibodies competed for binding to pKal with known active site-directed inhibitors. Second, antibodies were grouped according to whether they were inhibitors or just binders to pKal. Third, epitopes were investigated using synthetic peptides and peptidic structures based on the sequence and 3-dimensional structure of pKal. These peptidic structures are called "CLIPS" (Chemically Linked Peptides on Scaffolds) and the testing was performed by a fee for service company called Pepscan.

Fourth, antibodies were tested for their ability to inhibit pKal from other species, besides human, where the amino acid sequence of pKal has been determined in order to identify amino acids that may account for the differences in inhibition.

Competition Assays

Using a BIACORE® SPR assay antibodies of interest were tested for competition with a known active site inhibitor of pKal. EPI-KAL2 is potent ($K_{i,app}$=0.1 nM) active site inhibitor of pKal and a Kunitz domain inhibitor based on the first domain of tissue factor pathway inhibitor (Markland (1996) *Iterative optimization of high-affinity protease inhibitors using phage display*. 2. Plasma kallikrein and thrombin. *Biochemistry*, 35(24):8058-67). Kunitz domains are known active site inhibitors of serine proteases, such as pKal.

The sequence of EPI-KAL2 is:

```
                                      (SEQ ID NO: 2300)
EAMHSFCAFKADDGPCRAAHPRWFFNIFTRQC

EEFSYGGCGGNQNRFESLEECKKMCTRD
(amino acids in italics are those that differ
from TFPI)
```

Figure 8A:
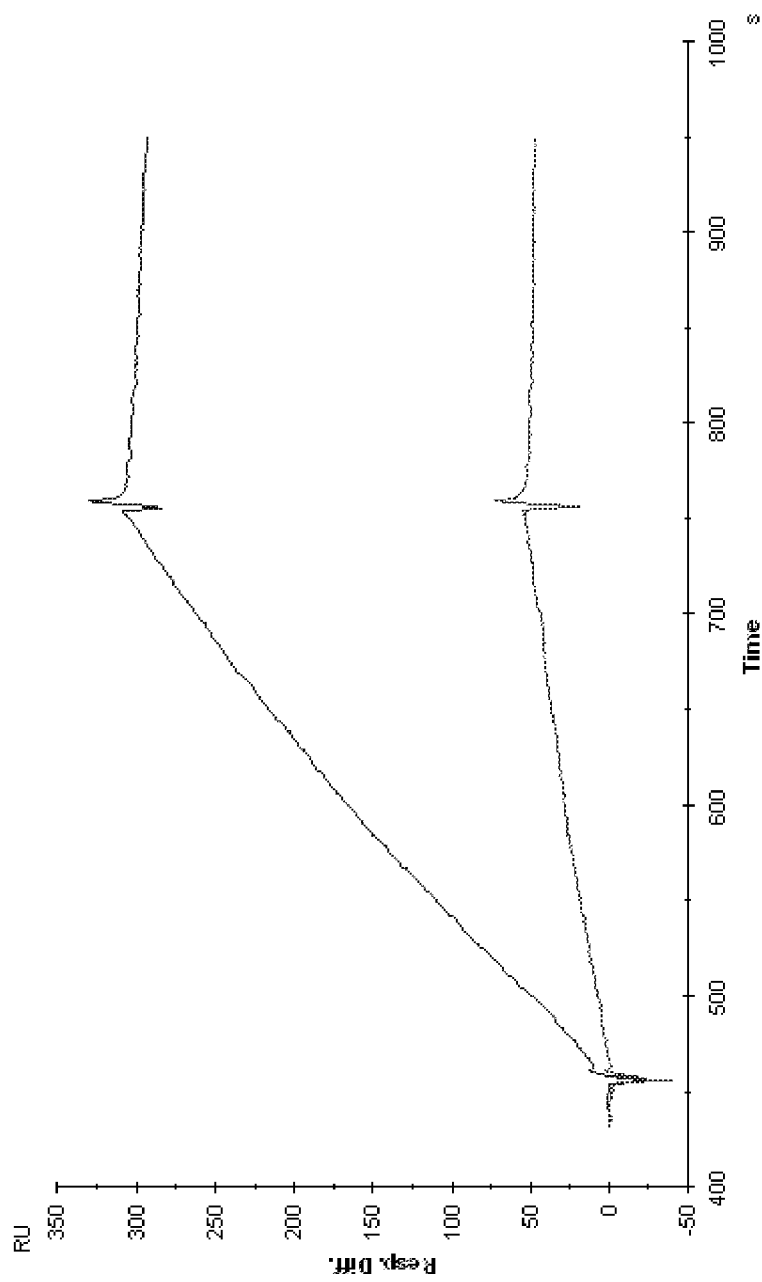
FIG. 8A depicts the EPI-KAL2 competition for X81-B01 binding pKal. X81-B01 (IgG) was captured on an anti-human Fc fragment specific surface of a CM5 BIACORE® chip. pKal (100 nM) was flowed over the surface in the presence (lower sensorgram in the figure) or absence of 1 µM EPI-KAL2 (upper sensorgram in the figure).
Figure 8B:
FIG. 8B depicts the EPI-KAL2 competition for X67-D03 binding pKal. X67-D03 (IgG) was captured on an anti-human Fc fragment specific surface of a CM5 Biacore chip. pKal (100 nM) was flowed over the surface in the presence (lower sensorgram in the figure) or absence of 1 µM EPI-KAL2 (upper sensorgram in the figure).

As shown in FIGS. 8A-8B, the antibodies X81-B01 and X67-D03 were competed for binding to pKal in the presence or EPI-KAL2. This result indicates that these antibodies either bind in vicinity of the active site or allosteric changes in the conformation of the pKal-EPI-KAL2 complex prevent antibody binding.

Antibody Binders vs Inhibitors

As shown in Tables 1 and 2, all the unique antibodies discovered by phage display were characterized as being either pKal inhibitors or binders but not inhibitors. Antibodies that inhibit the activity of pKal either bind near the active site and preclude substrate interactions (competitive inhibitors) or that bind away from the active site and induce allosteric changes in the structure of the active site (noncompetitive inhibitors). Antibodies that bind but do not inhibit pKal are unlikely to bind near the active site and may bind the non-catalytic domain (i.e. the apple domain). Table 12 categorizes selected antibodies as being either inhibitors or binders of pKal. Also shown in Table 12 for the listed antibodies, is a demonstration of whether they cross-react with mouse pKal as inhibitors and whether they bind prekallikrein.

TABLE 12

Binding Properties of Selected Anti-pKal Antibodies

| Number | Antibody | Binding Category | human Ki, app (nM) | mouse Ki, app (nM) | CLIPS Peptide(s) Identified |
|---|---|---|---|---|---|
| 1 | M6-A06 | 1) Binder only | no | no | C4 |
| 2 | M6-D09 | 2) inhibitor, prekallikrein binder, inhibits mouse and human pKal | 5.9 | 3.9 | C1, C5 |
| 3 | M8-C04 | 1) Binder only | no | no | |
| 4 | M8-G09 | 1) Binder only | no | no | C1, C4, C6, C7 |
| 5 | M29-D09 | 3) inhibitor, does not bind prekallikrein, does not inhibit mouse pKal | 0.7 | no | C1, C4, C7 |
| 6 | M35-G04 | 2) inhibitor, prekallikrein binder, inhibits mouse and human pKal | 2.9 | 8 | C1, C4 |
| 7 | M145-D11 | 3) inhibitor, does not bind prekallikrein, weak inhibitor of mouse pKal | 0.79 | 800 | C1, C4 |
| 8 | M160-G12 | 4) inhibitor of both mouse and human pKal, does not bind prekallikrein | 5 | 0.2 | C2 |

TABLE 12-continued

Binding Properties of Selected Anti-pKal Antibodies

| Number | Antibody | Binding Category | human Ki, app (nM) | mouse Ki, app (nM) | CLIPS Peptide(s) Identified |
|---|---|---|---|---|---|
| 9 | X55-F01 | 4) inhibitor of both mouse and human pKal, does not bind prekallikrein | 0.4 | 2 | C2, C3 |
| 10 | X73-H09 | 4) inhibitor, does not bind prekallikrein, weak inhibitor of human and mouse pKal | 20 | 70 | C6 |
| 11 | X81-B01 | 4) inhibitor of both mouse and human pKal, does not bind prekallikrein | 0.1 | 0.011 | C2, C3, C5, C6 |
| 12 | A2 | 5) Negative control, does not bind pKal, binds streptavidin | No binding | No binding | No binding |

C1-C7: peptides in pKal identified by CLIPS epitope mapping (see FIGS. 9 and 10A-10C).
C1 corresponds to positions 55-67 of the catalytic domain,
C2 to positions 81-94,
C3 to positions 101-108,
C4 to positions 137-151,
C5 to positions 162-178,
C6 to positions 186-197, and
C7 to positions 214-217.

Epitope Mapping Using CLIPS

The 11 anti-pKal antibodies listed in Table 12, plus one negative control (A2) were tested for binding to 5000 different synthetic CLIPS (Chemically Linked Peptides on Scaffolds) by Pepscan as described below in the CLIP METHODS sections. This analysis led to the identification of peptide regions in pKal that are likely to be a part of the antibody epitope for each of the tested antibodies (FIG. 9).

CLIPS Methods

The linear and CLIPS peptides were synthesized based on the amino acid sequence of the target protein using standard Fmoc-chemistry and deprotected using trifluoric acid with scavengers. The constrained peptides were synthesized on chemical scaffolds in order to reconstruct conformational epitopes, using Chemically Linked Peptides on Scaffolds (CLIPS) technology (Timmerman et al. (2007). For example, the single looped peptides were synthesized containing a dicysteine, which was cyclized by treating with alpha, alpha'-dibromoxylene and the size of the loop was varied by introducing cysteine residues at variable spacing. If other cysteines besides the newly introduced cysteines were present, they were replaced by alanine. The side-chains of the multiple cysteines in the peptides were coupled to CLIPS templates by reacting onto credit-card format polypropylene PEPSCAN cards (455 peptide formats/card) with a 0.5 mM solution of CLIPS template such as 1,3-bis(bromomethyl) benzene in ammonium bicarbonate (20 mM, pH 7.9)/acetonitrile (1:1(v/v)). The cards were gently shaken in the solution for 30 to 60 minutes while completely covered in solution. Finally, the cards were washed extensively with excess of $H_2O$ and sonicated in distrupt-buffer containing 1 percent SDS/0.1 percent beta-mercaptoethanol in PBS (pH 7.2) at 70° C. for 30 minutes, followed by sonication in $H_2O$ for another 45 minutes. The binding of antibody to each peptide were tested in a PEPSCAN-based ELISA. The 455-well credit card format polypropylene cards containing the covalently linked peptides were incubated with primary antibody solution for example consisting of 1 micrograms/mL diluted in blocking solution called SQ (4% horse serum, 5% ovalbumin (w/v) in PBS/1% Tween or diluted in PBS e.g., 20% SQ) overnight. After washing, the peptides were incubated with a 1/1000 dilution of rabbit anti-human antibody peroxidase or goat-anti-human FAB peroxidase for one hour at 25° C. After washing, the peroxidase substrate 2,2'-azino-di-3-ethylbenz-thiazoline sulfonate (ABTS) and 2 microliters of 3 percent $H_2O_2$ were added. After one hour, the color development was measured. The color development was quantified with a charge coupled device (CCD)—camera and an image processing system (as firstly described in Slootstra et al., 1996).

Data Calculation

Raw Data: Optical density (Arbitrary OD Units)

The raw data are optical values obtained by a CCD-camera. The values mostly range from 0 to 3000, a log scale similar to 1 to 3 of a standard 96-well plate elisa-reader. First the CCD-camera makes a picture of the card before peroxidase coloring and then again a picture after the peroxidase coloring. These two pictures are subtracted from each other which results in the data which is called raw-data. This is copied into the Peplab™ database. Then the values are copied to excel and this file is labeled as raw-data file. One follow-up manipulation is allowed. Sometimes a well contains an air-bubble resulting in a false-positive value, the cards are manually inspected and any values caused by an air-bubble are scored as 0.

Normally assays are not done in replicate (only upon request client request). Replicate tests are usually very similar. In addition, the dataset of thousands of peptides contains many peptides that are similar, thus results are never based on recognition of one peptide but on families of similar peptides. If one or a few peptides do not bind, or exhibit lower binding, in a replicate experiment, a different epitope mapping is not normally attributed.

Timmerman et al. (2007). Functional reconstruction and synthetic mimicry of a conformational epitope using CLIPS™ technology. *J. Mol. Recognit.* 20:283-99

Slootstra et al. (1996). Structural aspects of antibody-antigen interaction revealed through small random peptide libraries, *Molecular Diversity*, 1, 87-96.

Example 9

Analysis of pKal Sequences from Different Species

All available sequence of pKal were obtained from public databases and aligned using ClustalW and regions were highlighted based on solvent accessibility, contact with an active site Kunitz inhibitor, and those peptides identified by CLIPS analysis (FIGS. 10A-10C). Citrated plasma from each of these species was obtained and activated using a commercially available prekallikrein activator (from Enzyme Research Laboratories) according to the instructions of the manufacturer Kallikrein activity was then measured in each of the samples in the presence or absence of X81-B01.

It was found that X81-B01 inhibited pKal from all the species except for pig pKal. Since the CLIPS analysis identified four peptides of pKal that X81-B01 binds to—C2 (positions 81-94), C3 (positions 101-108), C5 (positions 162-178) and C6 (positions 186-197)—differences in the pig pKal sequence that correspond to these peptides were examined to identify potential amino acids changes that account for the lack of inhibition of pig pKal by X81-B01. Peptides C2 and C3 are close in the sequence and are both highly similar in sequence among the different species. However, there is a difference at position 479. All the species except pig, frog, and dog pKal have a serine at position 479. The frog and dog pKal sequence has an alanine and a threonine at position 479, respectively; both of which are considered conservative substitutions for a serine. In contrast, the pig pKal sequence has a leucine at position 479, which is a considerably less conservative substitution for a serine. Peptide C5 in pig pKal is highly similar to the sequences from the other species. However, at position 563, only in the pig pKal is a histidine present (bold in FIG. 10C). This position in all the other species, except frog, is a tyrosine. In the frog pKal, which is inhibited by X81-B01, this position is a threonine. Peptide C6 in pig pKal is again highly similar to the other sequences. However, only in the pig pKal sequence is position 585 a glutamate (in bold in FIG. 10C). In all the other species this position is an aspartate. This analysis may indicate potentially critical residues in pKal that interact with X81-B01.

Example 10

In Vitro and In Vivo Assays to Assess Efficacy of a Plasma Kallikrein Binding Protein Binding to prekallikrein vs. kallikrein:

The advantage of an antibody inhibitor of pKal that does not bind prekallikrein over an antibody that binds prekallikrein can be demonstrated experimentally. For example, an in vitro experiment can be designed to compare the potency of a pKal antibody inhibitor that does not bind prekallikrein (e.g. DX-2922 or DX-2930) with one that binds prekallikrein (e.g. M6-D09) using an activated partial thromboplastin time (APTT) plasma clotting time assay. The APTT assay induces clotting in plasma by the addition of a reagent that specifically activates the contact system component of the intrinsic coagulation pathway, of which the activity of pKal is involved. It is well known in the literature that the inhibition of pKal or that a genetic deficiency in pKal leads to prolonged aPPT (see e.g., Morishita, H., et al., Thromb Res, 1994. 73(3-4): p. 193-204; Wynne Jones, D., et al., Br J Haematol, 2004. 127(2): p. 220-3). An in vitro experiment can be performed to measure the effect of spiking citrated human plasma with different concentrations of either M6-D09 or DX-2922 or DX-2930 on observed clotting times induced using commercially available APTT reagents and a coagulation analyzer (Table 13). It is expected that the observed EC50 for APTT prolongation of M6-D09 will be significantly higher than that of DX-2922 and DX-2930 due to the binding of M6-D09 to the high concentration prekallikrein (~500 nM) in the normal plasma sample. Efficacy of the antibody inhibitor of pKal as demonstrated by prolonging APTT supports the potential therapeutic use of the antibody in treating or preventing cardiovascular disease associated with aberrant clot formation, such as may be observed in atherosclerosis, stroke, vasculitis, aneurism, and patients implanted with ventricular assist devices.

TABLE 13

Study Design to Measure Effect of Antibody Inhibitors of pKal on APTT

| Condition | Observed Effect on APPT |
| --- | --- |
| No treatment, just plasma | Normal |
| Prekallikrein depleted plasma control (commercially available) | Maximum prolongation |
| M6-D09 at low concentration | Normal |
| M6-D09 at middle concentration | Normal |
| M6-D09 at high concentration | Prolonged APTT |
| DX-2922 at low concentration | Prolonged APTT |
| DX-2922 at middle concentration | Prolonged APTT |
| DX-2922 at high concentration | Maximum prolongation |

Efficacy in a Rat Model of Edema:

An in vivo experiment can also be conducted to demonstrate the increased potency of an antibody inhibitor of pKal that does not bind prekallikrein. The carrageenan-induced paw edema (CPE) model of edema in rats is a common pharmacology model. A group of rats will be treated with escalating doses of M6-D09 and DX-2922 by intraperitoneal (IP) injection prior to injecting carrageenan (e.g. 0.1 mL of a 10% w/v solution) in the paws of the rats (Table 14). It is expected that DX-2922 will be more effective in reducing the observed paw swelling than M6-D09. Efficacy of the antibody supports the therapeutic use of the antibody in various inflammatory diseases that are associated with either swelling (e.g. hereditary angioedema, stroke induced edema, brain edema) or bradykinin mediated inflammation and pain (e.g. rheumatoid arthritis, inflammatory bowel disease).

TABLE 14

Study Design to Observe Effect of Antibody Inhibitors on CPE

| Group | Treatment | Example Dose (mg/Kg) | Effect Expected |
| --- | --- | --- | --- |
| 1 | Vehicle | N/A | Maximum swelling |
| 2 | Indomethacin (positive control) | 5 | Maximum reduction of swelling |
| 3 | M6-D09 | 1 | No effect on swelling |
| 4 | M6-D09 | 3 | No effect on swelling |
| 5 | M6-D09 | 10 | Intermediate reduction of swelling |
| 6 | DX-2922 | 1 | No effect on swelling |
| 7 | DX-2922 | 3 | Intermediate reduction of swelling |
| 8 | DX-2922 | 10 | Maximum reduction of swelling |

An in vivo experiment was conducted to demonstrate the anti-inflammatory potency and efficacy of a plasma kallikrein binding protein, DX-2930 after intraperitoneal and subcutaneous injection in the CPE model of edema in rats.

A group of rats where treated with escalating doses of DX-2930 by intraperitoneal (IP) injection prior to injecting carrageenan (e g 0.1 mL of a 1% w/v solution) in the paws of the rats. Paw swelling was measured by plethysmography according fluid displacement using established procedures. Indomethacin, the positive control for this experiment, was administered IP at 5 mg/Kg 30 minutes prior to carrageenan injection. The dose of DX-2930 was varied from 1, 3, 10, and 30 mg/Kg. Injection of 0.1 ml 1% carrageenan into the right hind paw resulted in a maximum 2-fold increase in paw volume four hours after challenge. Pretreatment with 5 mg/kg indomethacin inhibited this response by ~50% for the duration of the study. Intraperitoneal injection of DX-2930 thirty minutes prior to carrageenan challenge resulted in a dose-dependent inhibition of the carrageenan-induced response such that no amelioratory effect was observed at the 1 mg/kg dose, but that at the 30 mg/kg dose effects similar to indomethacin were measured.

DX-2930 was administered SC to rats 24 hours prior to the injection of a 0.1 mL 1% carrageenan solution into the right hind paw. Paw swelling was measured by plethysmography according fluid displacement using established procedures. Indomethacin, the positive control for this experiment, was administered IP at 5 mg/Kg 30 minutes prior to carrageenan injection. The dose of DX-2930 was varied from 1, 3, 10, and 30 mg/Kg. In contrast, subcutaneous injection of DX-2930 twenty-four hours prior to carrageenan challenge not only dose-dependently inhibited the carrageenan response, this treatment regimen yielded a significant improvement over indomethacin, delayed the development of the carrageenan-induced edema and significantly inhibited the carrageenan response at all doses throughout the time course of the study.

Measuring Half-Life:

The pharmacokinetic properties of DX-2922 and DX-2930 were determined in rats and the pharmacokinetic properties of DX-2930 was determined in cynomolgus monkeys. Serum was collected at the times indicated below. The concentration of DX-2922 and DX-2930 was determined by ELISA and plotted versus time in order to obtain pharmacokinetic parameters (clearance, half life, volume of distribution, etc).

Pharmacokinetics of DX-2922 and DX-2930 Following Single Intravenous, Subcutaneous or Intraperitoneal Administration in Rats The objective of this study was to evaluate the pharmacokinetics of DX-2922 and DX-2930, antibody inhibitors of plasma kallikrein, following a single intravenous (IV), subcutaneous (SC), or intraperitoneal (IP) injection to male Sprague-Dawley rats.

Forty two male Sprague-Dawley rats were assigned to 7 dose groups each consisting of 6 animals. All animals were dosed on Day 0. Groups 1 through 3 received a single IV injection of 1 mg/kg, 10 mg/kg, or 20 mg/kg DX-2922, respectively. Groups 4 and 5 received a single SC or IP injection of 20 mg/kg DX-2922, respectively. Groups 6 and 7 received a single IV or SC injection of 20 mg/kg DX-2930, respectively. On Day 0, blood was collected from 3 animals/group (Cohort 1) approximately 5 minutes and 4 hours post-dose. The 3 remaining animals/group (Cohort 2), were bled approximately 1 hour post-dose. All animals from each group were bled on Days 1, 2, 4, 7, 10, 14, 18, and 21. Serum samples were analyzed using a qualified ELISA method. Pharmacokinetic parameters were calculated using WinNonlin Professional Version 5.3 (Pharsight Inc., Cary, N.C.). All data were analyzed noncompartmentally. The study design is summarized in Table 15.

TABLE 15

Study Design

| Group | Test Article | Dose Level (mg/kg/day) | Route | Dose Concentration (mg/mL) | Dose Volume (mL/kg) | # Animals |
|---|---|---|---|---|---|---|
| 1 | DX-2922 | 1 | IV | 0.5 | 2 | 6 |
| 2 | DX-2922 | 10 | IV | 5 | 2 | 6 |
| 3 | DX-2922 | 20 | IV | 10 | 2 | 6 |
| 4 | DX-2922 | 20 | SC | 10 | 2 | 6 |
| 5 | DX-2922 | 20 | IP | 10 | 2 | 6 |
| 6 | DX-2930 | 20 | IV | 10 | 2 | 6 |
| 7 | DX-2930 | 20 | SC | 10 | 2 | 6 |

The pharmacokinetic parameter estimates are summarized in Table 16.

TABLE 16

Summary of Mean Pharmacokinetic Parameters

| Group | $C_{max}$ (µg/mL) | $AUC_{last}$ (hr*µg/mL) | CL (mL/hr/Kg) | Vss (mL/Kg) | $t^{1/2}$ (hr) | F (%) |
|---|---|---|---|---|---|---|
| 1 | 18.2 | 459.4 | 1.79 | 461.6 | 267.5 | n/a |
| 2 | 204.5 | 5178.5 | 1.72 | 314.2 | 204.6 | n/a |
| 3 | 384.4 | 9683.0 | 1.91 | 279.6 | 156.4 | n/a |
| 4 | 14.3 | 1912.4 | 10.23* | n/a | 115.4 | 20% |
| 5 | 0.12 | 26.12 | 629.93* | n/a | 200.53 | 0.3% |
| 6 | 414.6 | 39556.6 | 0.41 | 120.0 | 219.8 | n/a |
| 7 | 91.8 | 20421.3 | 0.97* | n/a | 57.7 | 52% | n/a: not applicable
*CL/F

DX-2922 serum concentrations were detected from 5 minutes post-dose to 504 hours (21 Days) post-dose in all dose groups. Mean $C_{max}$ and $AUC_{last}$ values following IV dosing were proportional to dose and increased in a linear fashion with increasing dose. IV clearance was rapid and independent of dose with mean values ranging from 1.72 mL/hr/Kg to 1.91 mL/hr/Kg across dose groups. Mean elimination half-life values decreased with increasing dose and ranged from 268 hours in the 1 mg/kg IV dose group to 156 hours in the 20 mg/kg dose group. Volume of distribution was greater than serum volume suggesting extravascular distribution. Following SC and IP dosing, the mean elimination half-life was 115 hours and 201 hours, respectively. The relative bioavailability when administered by the SC and IP routes were approximately 20% and 0.3%, respectively.

DX-2930 serum concentrations were detected from 5 minutes post-dose to 504 hours (21 Days) post-dose in all dose groups. Following IV dosing, mean $C_{max}$ and $AUC_{last}$ values were 415 µg/mL and 39557 µg/mL*hr, respectively. Mean clearance and elimination half-life values were 0.41 mL/hr/kg and 220 hours, respectively. Volume of distribution was consistent with serum volume suggesting limited extravascular distribution. The relative bioavailability when administered by the SC route was approximately 52%.

Figure 17:
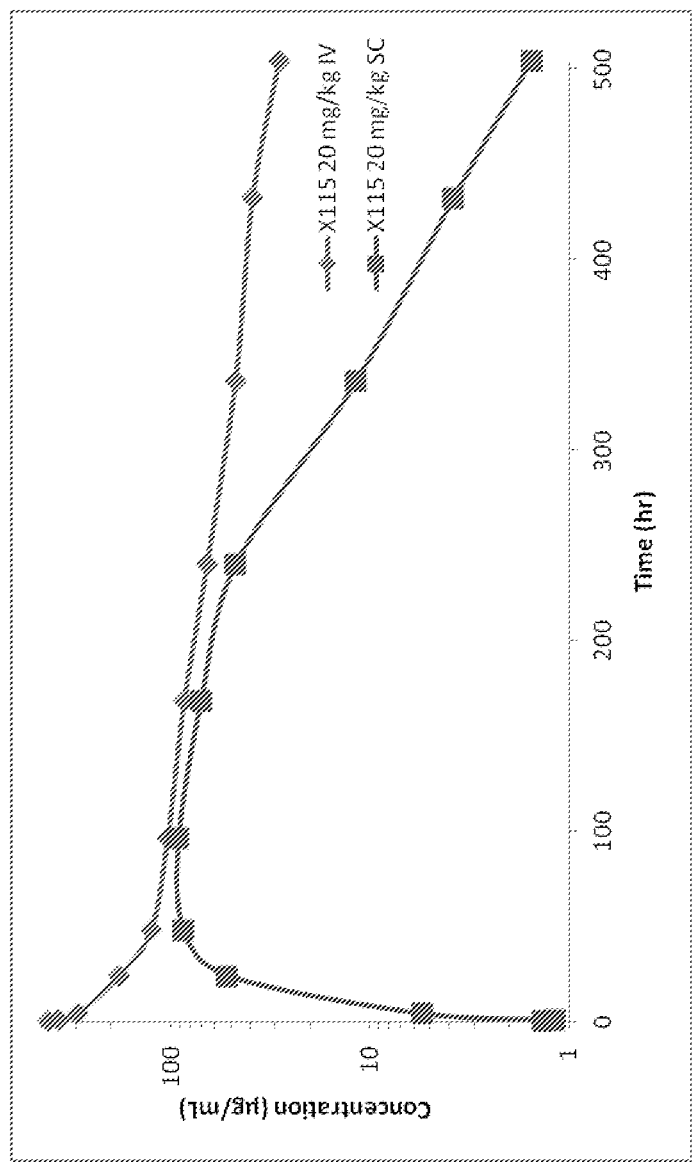
FIG. 17 depicts a graph showing mean DX-2930 serum concentrations following IV and SC administration to Sprague-Dawley rats for pharmacokinetic assessments.
Figure 18:
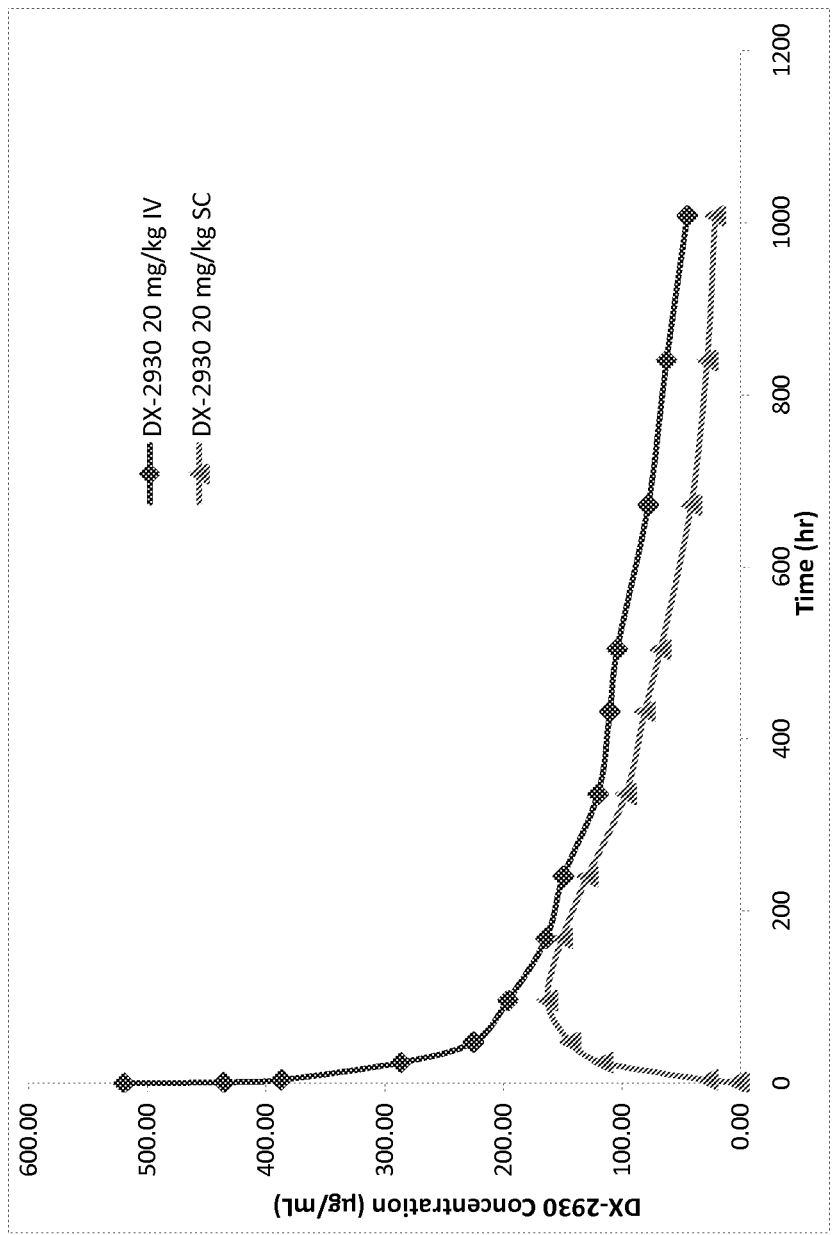
FIG. 18 depicts a graph showing mean DX-2930 serum concentrations following IV and SC administration to cynomolgus monkeys for pharmacokinetic assessments.

The mean serum concentration data for DX-2930 are shown graphically in FIG. 17 and FIG. 18.

Example 11

Epitope Mapping Using Amino Acid Mutations of pKal

Based on the epitope mapping studies described herein in Example 8, we inspected the published 3 dimensional model in the RCSB Protein Data Bank (available on the world wide web at rcsb.org; pdb code 2ANY) and identified a collection of sets of amino acids in surface accessible loops near the enzyme active site that we reasoned could interact with the antibody binding resulting in enzyme inhibition. These amino acids were substituted for alanine and the catalytic domain of each of the mutant was expressed in *Pichia pastoris* with a His tag fusion and purified by IMAC. Four different mutant pKal mutants were synthesized and tested:

Mutant 1: Amino acids S478, N481, S525, and K526 of the human kallikrein sequence (Accession No. NP_00883.2) were mutated to alanine. These amino acids were determined to be involved in substrate recognition (S3 subsite).

Mutant 2: Amino acid residues R551, Q553, Y555, T558 and R560 of the human kallikrein sequence (Accession No. NP_00883.2) were mutated to alanine. It was determined that these residues are involved in the active site substrate recognition (S1' subsite).

Mutant 3: Amino acids D572, K575, and D577 of the human kallikrein sequence (Accession No. NP_00883.2) were mutated to alanine. These amino acid residues are involved in substrate recognition (S1' subsite)

Mutant 4: Amino acids N395, S397 and S398 of the human kallikrein sequence (Accession No. NP_00883.2) were mutated to alanine. These residues are distal from the active site of plasma kallikrein.

Three of the 4 mutants (Mutant 1, 2, and 4) have similar activity to that of the wildtype catalytic domain of pKal. The amino acid substitutions in Mutant 3 yielded an inactive protein that was not recognized in SPR (Biacore) binding assays by any of the tested anti-pKal antibodies.

The antibodies tested for inhibition of mutants 1, 2 and 4 are shown herein in Table 17. Based on the measured $K_{i,app}$ values for the antibodies in Group 1 (i.e., antibodies that inhibit human and mouse pKal but do not bind prekallikrein) it is evident that this group of antibodies binds an epitope on pKal that contains the amino acids that were mutated in Mutant 2 but were not dependent on residues mutated in Mutants 1 or 4. In addition, the interaction of plasma kallikrein binding proteins X81-B01/X101-A01/DX-2922 and affinity matured derivative X115-B07 to kallikrein is adversely affected by the substitutions in Mutant 1. For an example of the differences in the ability of the antibodies to bind prekallikrein see e.g., FIGS. 11A and 11B, which compares prekallikrein the binding of DX-2922 (Group 1) to that of M6-D09 (Group 3).

The antibodies in Group 2 (i.e., those that inhibit human pKal not mouse pkal and do not bind prekallikrein) were not significantly affected by the mutated amino acids indicating that they make contact with alternate amino acids. The Group 2 antibodies are likely to bind near the active site, as they were unable to bind pKal complexed with a Kunitz domain (EPI-KAL2), which are known to bind at the active site of a serine protease. Furthermore, one of the antibodies in Group 2 (M145-D11) is similar to those in Group 1 in that it is unable to bind pKal in a Biacore assay that is inactivated with the suicide inhibitor AEBSF (4-(2-Aminoethyl) benzenesulfonyl fluoride hydrochloride), which is a small molecule covalent inhibitor of trypsin-like serine proteases (FIG. 12). However, the other antibody (M29-D09) assigned to Group 2 was able to bind AEBSF inactivated pKal, indicating that it may bind a different epitope than M145-D11 despite sharing similar binding properties.

The antibodies in Group 3 inhibited human and mouse pKal but bound prekallikrein. One of these antibodies, M6-D09, was unable to bind pKal inactivated by either EPI-KAL2 or AEBSF, indicating that this group of pKal inhibitors interacts with alternative amino acids near the active site. The $K_{i,app}$ for M6-D09 increased approximately 5-fold towards Mutant 2 (i.e., decreased potency of M6-D09).

Example 12

Affinity Maturation

In addition to the affinity maturation described herein in Examples 4 and 5, which involved optimization of the light chain we attempted to further optimize affinity with libraries that vary amino acids in the CDR1, CDR2, and CDR3 regions of the variable heavy chain of two different parental anti-pKal antibodies. Both of the antibodies selected for further optimization (X63-G06 and M162-A04) exhibit desirable properties for further development as a therapeutic antibody inhibitor of plasma kallikrein; properties which include: a) complete inhibition of human and rodent plasma kallikrein and b) no binding to prekallikrein. In some embodiments, complete inhibition of human pKal is essential to block the activity of plasma kallikrein in disease uses. Inhibition of rodent pKal facilitates preclinical development including toxicity assessment. The lack of binding to prekallikrein is a highly desirable property for an antibody inhibitor of pKal to maximize the bioavailability of the antibody therapeutic towards active pKal target and to potentially reduce the dose required for efficacy.

Affinity maturation was performed using 4 different phage display libraries. For each parental antibody (e.g., I62-A04), a library was constructed that contained varied amino acid positions in both the CDR1 and the CDR2 of the heavy chain. An additional library was constructed for each of the two parental antibodies wherein positions in the CDR3 of the heavy chain were varied. Each of these 4 phage display libraries were selected (panned) with decreasing amounts of active pKal in each subsequent round in order to obtain high affinity antibodies. To minimize the appearance of prekallikrein binding in the selected antibody output libraries were initially depleted against immobilized prekallikrein. After screening as Fab fragments, we discovered the affinity matured antibodies shown in Table 16 (i.e. the antibodies with the identification number starting with "X115").

Four discovered antibodies (X115-B07, X115-D05, X115-E09, and X115-H06) are derived from the DX-2922 parental antibody (also known as X63-G06 as a Fab fragment, X81-B01 as an IgG produced in 293T cells, or X101-A01 as an IgG produced in CHO cells) were found to be potent pKal inhibitors. For comparison the amino acid sequence of DX-2922 is shown. It is evident that three of the affinity matured antibodies (X115-B07, X115-E09, and X115-H06) contain mutations in Hv-CDR3; whereas X115-D05 has a different Hv-CDR1/CDR2. Four other discovered antibodies (X115-F02, X115-A03, X115-D01, and X115-G04) are derived from the M162-A04 parental antibody. All 8 affinity matured antibodies do not bind prekallikrein.

TABLE 17

Summary of Affinity Matured Anti-pKal Antibodies Inhibition Constants
(Ki, app) on Wild Type pKal Catalytic Domain and Mutants 1, 2, and 4[a].

| Isolate | WT cat. Domain Ki, app (nM) | Mutant 1 Ki, app (nM) | Mutant 2 Ki, app (nM) | Mutant 4 Ki, app (nM) | Competes with AEBSF | Competes with epi-kal2 | Characteristics |
|---|---|---|---|---|---|---|---|
| DX-2922 | 0.22 | 14 | 20 | 0.25 | y | y | inhibits human and mouse pKal; does not bind pre-kallikrein |
| 559A-X115-B07 (aff mat; X101-A01 parent) | 0.13 | 4.7 | 47 | 0.14 | y | nd | inhibits human and mouse pKal; does not bind pre-kallikrein |
| 559A-X115-D05 (aff mat; X101-A01 parent) | nd | nd | nd | nd | y | nd | inhibits human and mouse pKal; does not bind pre-kallikrein |
| 559A-X115-E09 (aff mat; X101-A01 parent) | nd | nd | nd | nd | y | nd | inhibits human and mouse pKal; does not bind pre-kallikrein |
| 559A-X115-H06 (aff mat; X101-A01 parent) | nd | nd | nd | nd | y | nd | inhibits human and mouse pKal; does not bind pre-kallikrein |
| 559A-X115-A03 (aff mat; M162-A04 parent) | 0.16 | 0.23 | 3.7 | 0.13 | y | nd | inhibits human and mouse pKal; does not bind pre-kallikrein |
| 559A-X115-D01 (aff mat; M162-A04 parent) | 0.18 | 0.26 | 2.5 | 0.12 | y | nd | inhibits human and mouse pKal; does not bind pre-kallikrein |
| 559A-X115-F02 (aff mat; M162-A04 parent) | 0.09 | 0.14 | 5.9 | 0.1 | y | y | inhibits human and mouse pKal; does not bind pre-kallikrein |
| 559A-X115-G04 (aff mat; M162-A04 parent) | 0.3 | 0.4 | 2.2 | 0.3 | y | y | inhibits human and mouse pKal; does not bind pre-kallikrein |
| 559A-M29-D09 (sFab)) | 0.24 | 0.27 | 0.34 | 0.39 | nd | y | inhibits human and mouse pKal; does not inhibit mouse pKal; does not bind pre-kallikrein |
| 559A-M145-D11 (sFab) | 0.16 | 0.23 | 0.1 | 0.21 | y | y | inhibits human and mouse pKal; weakly inhibits mouse pKal; does not bind pre-kallikrein |
| 559A-M06-D09 | 2.5 | 3.4 | 13.5 | 2.9 | y | y | inhibits human and mouse pKal; binds pre-kallikrein |
| 559A-M35-G04 | 0.8 | 0.09 | 1.1 | 0.8 | nd | nd | inhibits human and mouse pKal; binds pre-kallikrein |

[a]Antibodies were obtained from HV-CDR1/2 and HV-CDR3 affinity maturation, purified and tested for inhibition of either wild type pKal catalytic domain (Note, the antibodies inhibited full length wild type pKal approximately equal to that of the wild type catalytic domain).

TABLE 18

(SEQ ID NOS 2301-2384, respectively, in order of appearance):

| Isolate | LV-CDR1 | LV-CDR2 | LV-CDR3 | HV-CDR1 | HV-CDR2 | HV-CDR3 | Full length pKal Ki, app (nM) |
|---|---|---|---|---|---|---|---|
| DX-2922 | RTSQFVNSNYLA | GASSRAT | QQSSRTPWT | HYLMT | YISPSGGHTIYADSVKG | VARGIAARSRTSYFDY | 0.2 |
| X115-B07 | RTSQFVNSNYLA | GASSRAT | QQSSRTPWT | HYLMT | YISPSGGHTIYADSVKG | VGQGIRGRSRTSYFAQ | 0.33 |
| X115-D05 | RTSQFVNSNYLA | GASSRAT | QQSSRTPWT | DYMMA | SIVPSGGHTHYADSVKG | VARGIAARSRTSYFDY | 0.25 |
| X115-E09 | RTSQFVNSNYLA | GASSRAT | QQSSRTPWT | HYLMT | YISPSGGHTIYADSVKG | VAQGIAARSRTSSVDQ | 0.34 |
| X115-H06 | RTSQFVNSNYLA | GASSRAT | QQSSRTPWT | HYLMT | YISPSGGHTIYADSVKG | VAQGISARSRTSYFDY | 0.35 |
| M162-A04 | RASQSISSWLA | KASTLES | QQYNTYWT | HYIMM | GIYSSGGITVYADSVKG | RRTGIPRRDAFDI | |
| X115-A03 | RASQSISSWLA | KASTLES | QQYNTYWT | HYIMM | GIYSSGGITVYADSVKG | RRIGVPRRDSFDM | 0.16 |
| X115-D01 | RASQSISSWLA | KASTLES | QQYNTYWT | IYSMH | SIYPSRGMTWYADSVKG | RRTGIPRRDAFDI | 0.18 |
| X115-F02 | RASQSISSWLA | KASTLES | QQYNTYWT | HYIMM | GIYSSGGITVYADSVKG | RRIGVPRRDEFDI | 0.089 |
| X115-G04 | RASQSISSWLA | KASTLES | QQYNTYWT | HYIMM | GIYSSGGITVYADSVKG | RRTGVPRRDEFDI | 0.6 |

TABLE 18-continued (SEQ ID NOS 2301-2384, respectively, in order of appearance):

| | | | | | | | |
|---|---|---|---|---|---|---|---|
| M29-D09 | SGNKLGDKYVA | QDTKRPS | QAWDSSIVI | WYTMV | YIYPSGGATFYADSVKG | GSYDYIWGFYSDH | 0.7 |
| M145-D11 | SGDKLGDKYTS | QDIKRPS | QAWDSPNARV | HYRMS | SIYPSGGRTVYADSVKG | DKFEWRLLFRGIGNDAFDI | 0.79 |
| M06-D09 | RASQSIRNYLN | AASTLQS | QQLSGYPHT | FYYMV | VIYPSGGITVYADSVKG | DKWAVMPPYYYYAMDV | 5.9 |
| M35-G04 | RASQSVSSYLA | DASNRAT | QQRSNWPRGFT | YYHMS | VISPSGGSTKYADSVKG | GGSSDYAWGSYRRPYYFDY | 2.9 |

| Isolate | WT cat. Domain Ki, app (nM) | Mutant 1 Ki, app (nM) | Mutant 2 Ki, app (nM) | Mutant 4 Ki, app (nM) | competes with AEBSF | competes with epikal2 | Group |
|---|---|---|---|---|---|---|---|
| DX-2922 | 0.22 | 14 | 20 | 0.25 | y | y | 1 |
| X115-B07 | | 4.7 | 47 | 0.14 | y | nd | 1 |
| X115-D05 | nd | nd | nd | nd | y | nd | 1 |
| X115-E09 | nd | nd | nd | nd | y | nd | 1 |
| X115-H06 | nd | nd | nd | nd | y | nd | 1 |
| M162-A04 | nd | nd | nd | nd | y | y | 1 |
| X115-A03 | 0.16 | 0.23 | 3.7 | 0.13 | y | nd | 1 |
| X115-D01 | 0.18 | 0.26 | 2.5 | 0.12 | y | nd | 1 |
| X115-F02 | 0.09 | 0.14 | 5.9 | 0.1 | y | y | 1 |
| X115-G04 | 0.3 | 0.4 | 2.2 | 0.3 | y | y | 1 |
| M29-D09 | 0.24 | 0.27 | 0.34 | 0.39 | n | y | 2 |
| M145-D11 | 0.16 | 0.23 | 0.1 | 0.21 | y | y | 2 |
| M06-D09 | 2.5 | 3.4 | 13.5 | 2.9 | y | y | 3 |
| M35-G04 | 0.8 | 0.09 | 1.1 | 0.8 | nd | nd | 3 |

Equilibrium $K_{i,app}$ Measurements.

Apparent Inhibition constants ($K_{i,app}$ values) were measured by pre-incubating enzyme and inhibitor solutions prior to initiating the reactions with substrate. Enzyme and inhibitor were pre-incubated for 2 hours at 30° C. in a 96-well plate by adding 10 µL of a 10× enzyme solution and 10 µL of 10× inhibitor solutions to 70 µL of reaction buffer. Reactions were initiated by the addition of 10 µL of a 10× concentrated stock of substrate, and were monitored at 30° C. in a fluorescence plate reader with the excitation and emission wavelengths set at 360 nm/460 nm, respectively. Kinetic data were acquired by the increase in fluorescence, and initial rates for each condition were plotted against the total inhibitor concentration. The data was fit to the following equation for tight binding inhibitors:

$$A = A_o - A_{inh}\left(\frac{(K_{i,app} + Inh + E) - \sqrt{(K_{i,app} + Inh + E)^2 - 4 \cdot Inh \cdot E}}{2 \cdot E}\right) \quad \text{Eqn. 1}$$

Where A=initial rate observed at each inhibitor concentration; $A_o$=initial rate observed in the absence of inhibitor; $A_{inh}$=initial rate observed for the enzyme inhibitor complex; Inh=concentration of inhibitor; E=total enzyme concentration (treated as a floated parameter); and $K_{i,app}$=apparent equilibrium inhibition constant.

Groups of Antibody Inhibitors.

Antibodies in Group 1 inhibit human and mouse pKal but do not bind prekallikrein. Antibodies in Group 2 inhibit human but not mouse pKal and do not bind prekallikrein. Antibodies in Group 3 inhibit human and mouse pKal but bind prekallikrein.

Biacore Competition Analysis with an Exemplary Kallikrein Antibody, Epi-Kal2

Epi-Kal2 is an antibody inhibitor of kallikrein that acts by binding to the active site of kallikrein (for sequence see Example 8). The Biacore competition analysis is used herein as an assay to determine whether a test kallikrein antibody binds to the same site as epi-Kal2 and is assessed by measuring the competition (e.g., displacement) between epi-Kal2 and the test antibody for binding to the active site.

Goat anti-human Fc fragment specific IgG or anti-human Fab IgG was immobilized by amine coupling on a CM5 sensor chip at immobilization densities of approximately 5000 RU. Anti-pKal antibodies or sFabs were captured on their respective surfaces by injecting a 50 nM solution of IgG/sFab for 1-2 minutes at 5 at µl/min Human pKal (100 nM) or human pKal-ep-kal2 complex (100 nM hpKal that had been pre-incubated with 1 µM epi-kal2 for 1 hour at room temperature) were injected over the captured IgGs or sFabs for 5 minutes at 20-50 µl/min followed by a 5-10 minute dissociation phase. Binding responses were recorded at the end of the association phase. Anti-pKal IgGs or sFabs were considered to compete with epi-kal2 for binding to human pKal if binding of the pKal-epi-kal2 complex to anti-pKal antibodies was significantly reduced (>70%) as compared to an injection of hpKal only. The -continued 559A-X0115-G04-LV
DIQMTQSPSTLSASVGDRVTITCRASQSISSWLAWYQQKPGKAPKLLIYKASTLESGVPSRFSGSGSGTEF

TLTISSLQPDDFATYYCQQYNTYWTFGQGTKVEIK

559A-X0115-H06-LV
EIVLTQSPGTLSLSPGERATLSCRTSQFVNSNYLAWYQQKPGQAPRLLIYGASSRATGIPDRFSGSGSGTD

FTLTISRLEPEDFAVYYCQQSSRTPWTFGQGTKVEIK

559A-M0006-D09-LV
DIQMTQSPSSLSASVGDRVTITCRASQSIRNYLNWYQQKPGKAPNLLIYAASTLQSGVPARFSGSGSGTDF

TLTISSLQPEDFATYYCQQLSGYPHTFGQGTKLEIK

559A-M0035-G04-LV
QDIQMTQSPATLSLSPGERATLSCRASQSVSSYLAWYQQKPGQAPRLLIYDASNRATGIPARFSGSGSGTD

FTLTISSLEPEDFAVYYCQQRSNWPRGFTFGPGTKVDIK

559A-M0029-D09-HV
EVQLLESGGGLVQPGGSLRLSCAASGFTFSWYTMVWVRQAPGKGLEWVSYIYPSGGATFYADSVKGRFTIS

RDNSKNTLYLQMNSLRAEDTAVYYCAMGSYDYIWGFYSDHWGQGTLVTVSS

559A-M0145-D11-HV
EVQLLESGGGLVQPGGSLRLSCAASGFTFSHYRMSWVRQAPGKGLEWVSSIYPSGGRTVYADSVKGRFTIS

RDNSKNTLYLQMNSLRAEDTAVYYCAKDKFEWRLLFRGIGNDAFDIWGQGTMVTVSS

559A-M0162-A04-HV
EVQLLESGGGLVQPGGSLRLSCAASGFTFSHYIMMWVRQAPGKGLEWVSGIYSSGGITVYADSVKGRFTIS

RDNSKNTLYLQMNSLRAEDTAVYYCAYRRTGIPRRDAFDIWGQGTMVTVSS

559A-X0101-A01-HV
EVQLLESGGGLVQPGGSLRLSCAASGFTFSHYLMTWVRQAPGKGLEWVSYISPSGGHTIYADSVKGRFTIS

RDNSKNTLYLQMNSLRAEDTAVYYCARVARGIAARSRTSYFDYWGQGTLVTVSS

559A-X0115-A03-HV
EVQLLESGGGLVQPGGSLRLSCAASGFTFSHYIMMWVRQAPGKGLEWVSGIYSSGGITVYADSVKGRFTIS

RDNSKNTLYLQMNSLRAEDTAVYYCAWRRIGVPRRDSFDMWGQGTMVTVSS

559A-X0115-B07-HV
EVQLLESGGGLVQPGGSLRLSCAASGFTFSHYLMTWVRQAPGKGLEWVSYISPSGGHTIYADSVKGRFTIS

RDNSKNTLYLQMNSLRAEDTAVYYCAMVGQGIRGRSRTSYFAQWGQGTLVTVSS

559A-X0115-D01-HV
EVQLLESGGGLVQPGGSLRLSCAASGFTFSIYSMHWVRQAPGKGLEWVSSIYPSRGMTWYADSVKGRFTIS

RDNSKNTLYLQMNSLRAEDTAVYYCAYRRTGIPRRDAFDIWGQGTMVTVSS

559A-X0115-D05-HV
EVQLLESGGGLVQPGGSLRLSCAASGFTFSDYMMAWVRQAPGKGLEWVSSIVPSGGHTHYADSVKGRFTIS

RDNSKNTLYLQMNSLRAEDTAVYYCARVARGIAARSRTSYFDYWGQGTLVTVSS

559A-X0115-E09-HV
EVQLLESGGGLVQPGGSLRLSCAASGFTFSHYLMTWVRQAPGKGLEWVSYISPSGGHTIYADSVKGRFTIS

RDNSKNTLYLQMNSLRAEDTAVYYCARVAQGIAARSRTSSVDQWGQGTLVTVSS

559A-X0115-F02-HV
EVQLLESGGGLVQPGGSLRLSCAASGFTFSHYIMMWVRQAPGKGLEWVSGIYSSGGITVYADSVKGRFTIS

RDNSKNTLYLQMNSLRAEDTAVYYCAYRRIGVPRRDEFDIWGQGTMVTVSS

559A-X0124-G01-HV
EVQLLESGGGLVQPGGSLRLSCAASGFTFSHYIMMWVRQAPGKGLEWVSGIYSSGGITVYADSVKGRFTIS

RDNSKNTLYLQMNSLRAEDTAVYYCAYRRIGVPRRDEFDIWGQGTMVTVSS

559A-X0115-G04-HV
EVQLLESGGGLVQPGGSLRLSCAASGFTFSHYIMMWVRQAPGKGLEWVSGIYSSGGITVYADSVKGRFTIS

RDNSKNTLYLQMNSLRAEDTAVYYCAYRRTGVPRRDEFDIWGQGTMVTVSS

-continued

559A-X0115-H06-HV
EVQLLESGGGLVQPGGSLRLSCAASGFTFSHYLMTWVRQAPGKGLEWVSYISPSGGHTIYADSVKGRFTIS

RDNSKNTLYLQMNSLRAEDTAVYYCARVAQGISARSRTSYFDYWGQGTLVTVSS

559A-M0006-D09-HV
EVQLLESGGGLVQPGGSLRLSCAASGFTFSFYYMVWVRQAPGKGLEWVSVIYPSGGITVYADSVKGRFTIS

RDNSKNTLYLQMNSLRAEDTAVYYCARDKWAVMPPYYYYAMDVWGQGTTVTVSS

559A-M0035-G04-HV
EVQLLESGGGLVQPGGSLRLSCAASGFTFSYYHMSWVRQAPGKGLEWVSVISPSGGSTKYADSVKGRFTIS

RDNSKNTLYLQMNSLRAEDTAVYYCARGGSSDYAWGSYRRPYYFDYWGQGTLVTVSS

559A-M0029-D09 LV
CAGAGCGCTTTGACTCAGCCACCCACAGTGTCTGTGTCCCCAGGACAGACAGCCAGGATCACCTGCTCTGG

AAATAAATTGGGGGATAAATATGTTGCCTGGTATCAGCAGAAGCCAGGCCAGTCCCCTATGTTGGTCATCT

ATCAAGATACTAAGCGCCCCTCAAGAGTTTCTGAGCGATTCTCTGGCTCCAACTCTGCGAATACAGCCACT

CTGTCCATCAGCGGGACCCAGGCTCTGGATGAGGCTGACTATTACTGTCAGGCGTGGGACAGCAGCATTGT

GATCTTCGGCGGAGGGACCAGGCTGACCGTCCTA

559A-M0145-D11 LV
CAGAGCGTCTTGACTCAGCCACCCTCAGTGTCCGTGTCTCCAGGACAGACAGCCAGCATCACCTGCTCTGG

AGATAAATTGGGGGATAAATATACTTCCTGGTATCAGCAGAGGCCAGGCCAGTCCCCTGTATTGGTCATCT

ATCAAGATATCAAGCGGCCCTCAGGGATCCCTGAGCGATTCTCTGGCTCCAACTCTGGGAACACAGCCACT

CTGACCATCAGCGGGACCCAGGCTATGGATGAGGCTGACTATTACTGTCAGGCGTGGGACAGTCCCAATGC

GAGGGTCTTCGGATCTGGGACCAAGGTCACCGTCCTA

559A-M0162-A04 LV
GACATCCAGATGACCCAGTCTCCTTCCACCCTGTCTGCATCTGTAGGAGACAGAGTCACCATCACTTGCCG

GGCCAGTCAGAGTATCAGTAGTTGGTTGGCCTGGTATCAGCAGAAACCAGGGAAAGCCCCTAACCTCCTGA

TCTATAAGGCGTCTACTTTAGAAAGTGGGGTCCCATCAAGGTTCAGCGGCAGTGGATCTGGGACAGAATTC

ACTCTCACCATCAGCAGCCTGCAGCCTGATGATTTTGCAACTTATTACTGCCAACAGTATAATACTTATTG

GACGTTCGGCCAAGGGACCAAGGTGGAAATCAAA

559A-X0101-A01 LV
GAGATCGTGCTGACCCAGTCCCCTGGCACCCTGTCTCTGTCTCCCGGCGAGAGAGCCACCCTGTCCTGCCG

GACCTCCCAGTTCGTGAACTCCAACTACCTGGCTTGGTATCAGCAGAAGCCAGGCCAGGCCCCTAGACTGC

TGATCTACGGCGCCTCTTCCAGAGCCACCGGCATCCCTGACCGGTTCTCCGGCTCTGGCTCCGGCACCGAC

TTCACCCTGACCATCTCCCGGCTGGAACCTGAGGACTTCGCCGTGTACTACTGCCAGCAGTCCTCCCGGAC

CCCTTGGACCTTTGGCCAGGGCACCAAGGTGGAGATCAAG

559A-X0115-A03 LV
GACATCCAGATGACCCAGTCCCCCTCCACCCTGTCCGCCTCTGTGGGCGACAGAGTGACCATCACCTGTCG

GGCCTCCCAGTCCATCTCCAGCTGGCTGGCCTGGTATCAGCAGAAGCCCGGCAAGGCCCCCAAGCTGCTGA

TCTACAAGGCCAGCACCCTGGAATCCGGCGTGCCCTCCAGATTCTCCGGCTCTGGCTCCGGCACCGAGTTC

ACCCTGACCATCAGCTCCCTGCAGCCCGACGACTTCGCCACCTACTACTGCCAGCAGTACAACACCTACTG

GACCTTCGGCCAGGGCACCAAGGTGGAAATCAAG

559A-X0115-B07 LV
GAGATCGTGCTGACCCAGTCCCCTGGCACCCTGTCTCTGTCTCCCGGCGAGAGAGCCACCCTGTCCTGCCG

GACCTCCCAGTTCGTGAACTCCAACTACCTGGCTTGGTATCAGCAGAAGCCAGGCCAGGCCCCTAGACTGC

TGATCTACGGCGCCTCTTCCAGAGCCACCGGCATCCCTGACCGGTTCTCCGGCTCTGGCTCCGGCACCGAC

TTCACCCTGACCATCTCCCGGCTGGAACCTGAGGACTTCGCCGTGTACTACTGCCAGCAGTCCTCCCGGAC

CCCTTGGACCTTTGGCCAGGGCACCAAGGTGGAGATCAAG

559A-X0115-D01 LV
GACATCCAGATGACCCAGTCCCCCTCCACCCTGTCCGCCTCTGTGGGCGACAGAGTGACCATCACCTGTCG

GGCCTCCCAGTCCATCTCCAGCTGGCTGGCCTGGTATCAGCAGAAGCCCGGCAAGGCCCCCAAGCTGCTGA

TCTACAAGGCCAGCACCCTGGAATCCGGCGTGCCCTCCAGATTCTCCGGCTCTGGCTCCGGCACCGAGTTC

ACCCTGACCATCAGCTCCCTGCAGCCCGACGACTTCGCCACCTACTACTGCCAGCAGTACAACACCTACTG

GACCTTCGGCCAGGGCACCAAGGTGGAAATCAAG

559A-X0115-D05 LV
GAGATCGTGCTGACCCAGTCCCCTGGCACCCTGTCTCTGTCTCCCGGCGAGAGAGCCACCCTGTCCTGCCG

GACCTCCCAGTTCGTGAACTCCAACTACCTGGCTTGGTATCAGCAGAAGCCAGGCCAGGCCCCTAGACTGC

TGATCTACGGCGCCTCTTCCAGAGCCACCGGCATCCCTGACCGGTTCTCCGGCTCTGGCTCCGGCACCGAC

TTCACCCTGACCATCTCCCGGCTGGAACCTGAGGACTTCGCCGTGTACTACTGCCAGCAGTCCTCCCGGAC

CCCTTGGACCTTTGGCCAGGGCACCAAGGTGGAGATCAAG

559A-X0115-E09 LV
GAGATCGTGCTGACCCAGTCCCCTGGCACCCTGTCTCTGTCTCCCGGCGAGAGAGCCACCCTGTCCTGCCG

GACCTCCCAGTTCGTGAACTCCAACTACCTGGCTTGGTATCAGCAGAAGCCAGGCCAGGCCCCTAGACTGC

TGATCTACGGCGCCTCTTCCAGAGCCACCGGCATCCCTGACCGGTTCTCCGGCTCTGGCTCCGGCACCGAC

TTCACCCTGACCATCTCCCGGCTGGAACCTGAGGACTTCGCCGTGTACTACTGCCAGCAGTCCTCCCGGAC

CCCTTGGACCTTTGGCCAGGGCACCAAGGTGGAGATCAAG

559A-X0115-F02 LV
GACATCCAGATGACCCAGTCCCCCTCCACCCTGTCCGCCTCTGTGGGCGACAGAGTGACCATCACCTGTCG

GGCCTCCCAGTCCATCTCCAGCTGGCTGGCCTGGTATCAGCAGAAGCCCGGCAAGGCCCCCAAGCTGCTGA

TCTACAAGGCCAGCACCCTGGAATCCGGCGTGCCCTCCAGATTCTCCGGCTCTGGCTCCGGCACCGAGTTC

ACCCTGACCATCAGCTCCCTGCAGCCCGACGACTTCGCCACCTACTACTGCCAGCAGTACAACACCTACTG

GACCTTCGGCCAGGGCACCAAGGTGGAAATCAAG

559A-X0115-G04 LV
GACATCCAGATGACCCAGTCCCCCTCCACCCTGTCCGCCTCTGTGGGCGACAGAGTGACCATCACCTGTCG

GGCCTCCCAGTCCATCTCCAGCTGGCTGGCCTGGTATCAGCAGAAGCCCGGCAAGGCCCCCAAGCTGCTGA

TCTACAAGGCCAGCACCCTGGAATCCGGCGTGCCCTCCAGATTCTCCGGCTCTGGCTCCGGCACCGAGTTC

ACCCTGACCATCAGCTCCCTGCAGCCCGACGACTTCGCCACCTACTACTGCCAGCAGTACAACACCTACTG

GACCTTCGGCCAGGGCACCAAGGTGGAAATCAAG

559A-X0115-H06 LV
GAGATCGTGCTGACCCAGTCCCCTGGCACCCTGTCTCTGTCTCCCGGCGAGAGAGCCACCCTGTCCTGCCG

GACCTCCCAGTTCGTGAACTCCAACTACCTGGCTTGGTATCAGCAGAAGCCAGGCCAGGCCCCTAGACTGC

TGATCTACGGCGCCTCTTCCAGAGCCACCGGCATCCCTGACCGGTTCTCCGGCTCTGGCTCCGGCACCGAC

TTCACCCTGACCATCTCCCGGCTGGAACCTGAGGACTTCGCCGTGTACTACTGCCAGCAGTCCTCCCGGAC

CCCTTGGACCTTTGGCCAGGGCACCAAGGTGGAGATCAAG

559A-M0006-D09 LV
GACATCCAGATGACCCAGTCTCCATCCTCCCTGTCTGCATCTGTAGGAGACAGAGTCACCATCACTTGCCG

GGCAAGTCAGAGTATTCGCAACTATTTAAATTGGTATCAGCAGAAACCAGGGAAAGCCCCTAACCTCCTGA

TCTATGCTGCATCCACTTTGCAAAGTGGGGTCCCAGCAAGGTTCAGTGGCAGTGGATCTGGGACAGATTTC

ACTCTCACTATCAGCAGTCTGCAGCCTGAAGATTTTGCAACTTATTACTGTCAACAGCTTAGTGGTTACCC

CCACACTTTTGGCCAGGGGACCAAGCTGGAGATCAAA

559A-M0035-G04 LV
CAAGACATCCAGATGACCCAGTCTCCAGCCACCCTGTCTTTGTCTCCAGGGGAAAGAGCCACCCTCTCCTG

CAGGGCCAGTCAGAGTGTTAGCAGCTACTTAGCCTGGTACCAACAGAAACCTGGCCAGGCTCCCAGGCTCC

TCATCTATGATGCATCCAACAGGGCCACTGGCATCCCAGCCAGGTTCAGTGGCAGTGGGTCTGGGACAGAC

TTCACTCTCACCATCAGCAGCCTAGAGCCTGAAGATTTTGCAGTTTATTACTGTCAGCAGCGTAGCAACTG

GCCTCGCGGATTCACTTTCGGCCCTGGGACCAAAGTGGATATCAAA

559A-M0029-D09 HV
GAAGTTCAATTGTTAGAGTCTGGTGGCGGTCTTGTTCAGCCTGGTGGTTCTTTACGTCTTTCTTGCGCTGC

TTCCGGATTCACTTTCTCTTGGTACACTATGGTTTGGGTTCGCCAAGCTCCTGGTAAAGGTTTGGAGTGGG

TTTCTTATATCTATCCTTCTGGTGGCGCTACTTTTTATGCTGACTCCGTTAAAGGTCGCTTCACTATCTCT

AGAGACAACTCTAAGAATACTCTCTACTTGCAGATGAACAGCTTAAGGGCTGAGGACACGGCCGTGTATTA

CTGTGCGATGGGTTCATATGATTACATTTGGGGATTTTATAGTGACCACTGGGGCCAGGGAACCCTGGTCA

CCGTCTCAAGC

559A-M0145-D11 HV
GAAGTTCAATTGTTAGAGTCTGGTGGCGGTCTTGTTCAGCCTGGTGGTTCTTTACGTCTTTCTTGCGCTGC

TTCCGGATTCACTTTCTCTCATTACCGTATGTCTTGGGTTCGCCAAGCTCCTGGTAAAGGTTTGGAGTGGG

TTTCTTCTATCTATCCTTCTGGTGGCCGTACTGTTTATGCTGACTCCGTTAAAGGTCGCTTCACTATCTCT

AGAGACAACTCTAAGAATACTCTCTACTTGCAGATGAACAGCTTAAGGGCTGAGGACACGGCCGTGTATTA

CTGTGCGAAAGATAAGTTCGAGTGGAGGTTATTATTTCGCGGGATTGGAAATGATGCTTTTGATATCTGGG

GCCAAGGGACAATGGTCACCGTCTCAAGC

559A-M0162-A04 HV
GAAGTTCAATTGTTAGAGTCTGGTGGCGGTCTTGTTCAGCCTGGTGGTTCTTTACGTCTTTCTTGCGCTGC

TTCCGGATTCACTTTCTCTCATTACATTATGATGTGGGTTCGCCAAGCTCCTGGTAAAGGTTTGGAGTGGG

TTTCTGGTATCTATTCTTCTGGTGGCATTACTGTTTATGCTGACTCCGTTAAAGGTCGCTTCACTATCTCT

AGAGACAACTCTAAGAATACTCTCTACTTGCAGATGAACAGCTTAAGGGCTGAGGACACGGCCGTGTATTA

CTGTGCGTACCGCCGGACTGGGATTCCAAGAAGAGATGCTTTTGATATCTGGGGCCAAGGGACAATGGTCA

CCGTCTCAAGC

559A-X0101-A01 HV
GAGGTGCAATTGCTGGAATCCGGCGGAGGTCTGGTGCAGCCTGGCGGCTCCCTGAGACTGTCTTGCGCCGC

CTCCGGCTTCACCTTCTCCCACTACCTGATGACCTGGGTGCGCCAGGCTCCTGGCAAGGGCCTCGAATGGG

TGTCCTACATCTCCCCCTCTGGCGGCCACACCATCTACGCCGACTCCGTGAAGGGCCGGTTCACCATCTCC

CGGGACAACTCCAAGAACACCCTGTATCTGCAGATGAACTCCCTGAGGGCCGAGGACACCGCCGTGTACTA

CTGCGCCAGGGTGGCCAGAGGAATCGCCGCCAGGTCCCGGACCTCCTACTTCGACTACTGGGGCCAGGGCA

CCCTGGTGACCGTGTCCTCC

559A-X0115-A03 HV
GAGGTGCAATTGCTGGAATCCGGCGGAGGACTGGTGCAGCCTGGCGGCTCCCTGAGACTGTCTTGCGCCGC

CTCCGGCTTTACCTTCTCCCACTACATCATGATGTGGGTGCGACAGGCTCCAGGCAAGGGCCTGGAATGGG

TGTCCGGCATCTACTCCTCCGGCGGCATCACCGTGTACGCCGACTCCGTGAAGGGCCGGTTCACCATCTCC

CGGGACAACTCCAAGAACACCCTGTACCTGCAGATGAACTCCCTGCGGGCCGAGGACACCGCCGTGTACTA

CTGTGCCTGGCGGAGAATCGGCGTGCCCAGACGGGACTCCTTCGACATGTGGGGACAGGGCACCATGGTGA

CAGTGTCCTCC

559A-X0115-B07 HV
GAGGTGCAATTGCTGGAATCCGGCGGAGGACTGGTGCAGCCTGGCGGCTCCCTGAGACTGTCTTGCGCCGC

CTCCGGCTTCACCTTCTCCCACTACCTGATGACCTGGGTGCGACAGGCTCCTGGCAAAGGCCTGGAATGGG

TGTCCTACATCTCCCCCTCTGGCGGCCACACCATCTACGCCGACTCCGTGAAGGGCCGGTTTACCATCTCC

CGGGACAACTCCAAGAACACCCTGTACCTGCAGATGAACTCCCTGCGGGCCGAGGACACCGCCGTGTACTA

-continued

CTGTGCCATGGTCGGCCAGGGAATCCGGGGCAGATCCCGGACCTCCTACTTCGCCCAGTGGGGCCAGGGCA

CCCTGGTGACAGTGTCCTCT

559A-X0115-D01 HV
GAGGTGCAATTGCTGGAATCCGGCGGAGGACTGGTGCAGCCTGGCGGCTCCCTGAGACTGTCTTGCGCCGC

CTCCGGCTTCACCTTCTCCATCTACTCCATGCACTGGGTGCGACAGGCTCCAGGCAAGGGCCTGGAATGGG

TGTCCTCCATCTACCCCTCCCGGGGCATGACTTGGTACGCCGACTCCGTGAAGGGCCGGTTCACAATCTCC

CGGGACAACTCCAAGAACACCCTGTACCTGCAGATGAACTCCCTGCGGGCCGAGGACACCGCCGTGTACTA

CTGCGCCTACCGGCGGACCGGCATCCCTAGACGGGACGCCTTCGACATCTGGGGCAGGGCACCATGGTGA

CAGTGTCCTCC

559A-X0115-D05 HV
GAGGTGCAATTGCTGGAATCCGGCGGTGGACTGGTGCAGCCTGGCGGCTCCCTGAGACTGTCTTGCGCCGC

CTCCGGCTTCACCTTCTCCGACTACATGATGGCCTGGGTGCGACAGGCCCCTGGCAAGGGACTGGAATGGG

TGTCCTCCATCGTGCCCTCTGGCGGCCACACCCACTACGCCGACTCCGTGAAGGGCCGGTTCACCATCTCC

CGGGACAACTCCAAGAACACCCTGTACCTGCAGATGAACTCCCTGCGGGCCGAGGACACCGCCGTGTACTA

CTGCGCCAGAGTGGCCAGAGGAATCGCCGCCAGATCCCGGACCTCCTACTTCGACTACTGGGGCCAGGGCA

CCCTGGTGACAGTGTCCTCC

559A-X0115-E09 HV
GAGGTGCAATTGCTGGAATCCGGCGGAGGACTGGTGCAGCCTGGCGGCTCCCTGAGACTGTCTTGCGCCGC

CTCCGGCTTCACCTTCTCCCACTACCTGATGACCTGGGTGCGACAGGCTCCTGGCAAAGGCCTGGAATGGG

TGTCCTACATCTCCCCCTCTGGCGGCCACACCATCTACGCCGACTCCGTGAAGGGCCGGTTTACCATCTCC

CGGGACAACTCCAAGAACACCCTGTACCTGCAGATGAACTCCCTGCGGGCCGAGGACACCGCCGTGTACTA

CTGTGCCCGGGTGGCCCAGGGAATCGCCGCCAGATCCCGGACCTCCTCTGTGGATCAGTGGGGCCAGGGCA

CCCTGGTGACAGTGTCCTCT

559A-X0115-F02 HV
GAGGTGCAATTGCTGGAATCCGGCGGAGGACTGGTGCAGCCTGGCGGCTCCCTGAGACTGTCTTGCGCCGC

CTCCGGCTTCACCTTCTCCCACTACATCATGATGTGGGTGCGACAGGCTCCTGGCAAGGGGCTGGAATGGG

TGTCCGGCATCTACTCCTCCGGCGGCATCACCGTGTACGCCGACTCCGTGAAGGGCCGGTTCACCATCTCT

CGGGACAACTCCAAGAACACCCTGTACCTGCAGATGAACTCCCTGCGGGCCGAGGACACCGCCGTGTACTA

CTGCGCCTACCGGCGGATCGGCGTGCCCAGACGGGACGAGTTCGACATCTGGGGCAGGGCACCATGGTGA

CAGTGTCCTCC

559A-X0115-G04 HV
GAGGTGCAATTGCTGGAATCCGGCGGAGGACTGGTGCAGCCTGGCGGCTCCCTGAGACTGTCTTGCGCCGC

CTCCGGCTTCACCTTCTCTCACTACATTATGATGTGGGTGCGACAGGCTCCTGGCAAAGGCCTGGAATGGG

TGTCCGGCATCTACTCCTCCGGCGGCATCACCGTGTACGCCGACTCCGTGAAGGGCCGGTTCACCATCTCC

CGGGACAACTCCAAGAACACCCTGTACCTGCAGATGAACTCCCTGCGGGCCGAGGACACCGCCGTGTACTA

CTGCGCCTACAGACGGACCGGCGTGCCCAGACGGGACGAGTTCGATATCTGGGGCAGGGCACCATGGTGA

CAGTGTCCTCC

559A-X0115-H06 HV
GAGGTGCAATTGCTGGAATCCGGCGGAGGACTGGTGCAGCCTGGCGGCTCCCTGAGACTGTCTTGCGCCGC

CTCCGGCTTCACCTTCTCCCACTACCTGATGACCTGGGTGCGACAGGCTCCTGGCAAAGGCCTGGAATGGG

TGTCCTACATCTCCCCCTCTGGCGGCCACACCATCTACGCCGACTCCGTGAAGGGCCGGTTTACCATCTCC

CGGGACAACTCCAAGAACACCCTGTACCTGCAGATGAACTCCCTGCGGGCCGAGGACACCGCCGTGTACTA

CTGTGCCCGGGTGGCCCAGGGAATCTCCGCCAGATCCCGGACCTCCTACTTCGATTACTGGGGCCAGGGCA

CCCTGGTGACAGTGTCCTCT

-continued

559A-M0006-D09 HV
GAAGTTCAATTGTTAGAGTCTGGTGGCGGTCTTGTTCAGCCTGGTGGTTCTTTACGTCTTTCTTGCGCTGC

TTCCGGATTCACTTTCTCTTTTTACTATATGGTTTGGGTTCGCCAAGCTCCTGGTAAAGGTTTGGAGTGGG

TTTCTGTTATCTATCCTTCTGGTGGCATTACTGTTTATGCTGACTCCGTTAAAGGTCGCTTCACTATCTCT

AGAGACAACTCTAAGAATACTCTCTACTTGCAGATGAACAGCTTAAGGGCTGAGGACACGGCCGTGTATTA

CTGTGCGAGAGATAAATGGGCGGTGATGCCCCCCTACTACTACTACGCTATGGACGTCTGGGGCCAAGGGA

CCACGGTCACCGTCTCAAGC

559A-M0035-G04 HV
GAAGTTCAATTGTTAGAGTCTGGTGGCGGTCTTGTTCAGCCTGGTGGTTCTTTACGTCTTTCTTGCGCTGC

TTCCGGATTCACTTTCTCTTATTACCATATGTCTTGGGTTCGCCAAGCTCCTGGTAAAGGTTTGGAGTGGG

TTTCTGTTATCTCTCCTTCTGGTGGCTCTACTAAGTATGCTGACTCCGTTAAAGGTCGCTTCACTATCTCT

AGAGACAACTCTAAGAATACTCTCTACTTGCAGATGAACAGCTTAAGGGCTGAGGACACTGCAGTCTACTA

TTGTGCGAGAGGCGGTTCGAGCGATTACGCTTGGGGGAGTTATCGTCGACCCTACTACTTTGACTACTGGG

GCCAGGGAACCCTGGTCACCGTCTCAAGC

Example 13

URP Fusion Proteins of Plasma Kallikrein Binding Proteins

Table 19 shows an annotated sequence of the vector pM160G12URP12 that, in *E. coli*, can cause the secretion of the light chain (LC) of M160-G12 fused to URP1 and the heavy chain (HC) of M160-G12 fused to URP2. In Table 19, the numbered DNA sequence is accompanied with comments, which are denoted on each line following an exclamation point (!). The URPs have no secondary structure in the amino-acid sequence. These sequences are derived from the digits of pi.

URP1 is derived from the first 420 digits of pi. If I is a digit in pi and J is the next digit, then IM=1+integer ((10*I+j)/16).

If 1M is 1 or 7, the next AA is Gly, IM=2 gives Ala, 3 gives Ser, 4 gives Thr, 5 gives Glu, and 6 gives Pro. URP2 uses digits 421-840. Table 20 contains the unannotated sequence of pM160G12URP12. Table 21 gives the amino-acid sequence of LC(M160-G12)::URP1. Table 22 shows DNA that encodes HC(M160-G12)::URP2. Table 23 shows the amino-acid sequence of HC(M160-G12)::URP2.

Tables 19-23 all show the plasma kallikrein inhibiting Fab of M160-G12, an exemplary plasma kallikrein. It is contemplated herein that any of the antibodies described herein can be put into this or a similar construction. In addition, other sequences could be used for the URPs. In particular, the antibodies M162-A04, M142-H08, X63-G06, X81-B01, X67-D03, and X67-G04 could be substituted for M160-G12. Sequences from U.S. Pat. No. 7,846,445 (herein incorporated by reference in its entirety) can also be used with the plasma kallikrein binding proteins described herein.

TABLE 19 pM160G12URP12, annotated

```
!559A-M160-G12_0III 5932 by DNA circular

!Input+32F:\pKal_Ab\559a-m160-g12_LCHC_03_urpv2.ibi

!559A-M160-G12::URP 5932 CIRCULAR

! Ngene = 5932

!

! Useful REs (cut MAnoLI fewer than 3 times) 2003.02.04

!

! Non-cutters

!AfeI  AGCgct                    AvrII  Cctagg                   BamHI  Ggatcc

!BoiI  Tgatca                    BglII  Agatct                   BmgBI  CACgtc

!BsaBI GATNNnnatc                BsiWI  Cgtacg                   BsmI   NGcattc
 (SEQ ID NO: 2443)

!BspDI ATcgat                    BspMI  Nnnnnnnnngcaggt          BsrGI  Tgtaca
                                  (SEQ ID NO: 2444)
```

TABLE 19-continued pM160G12URP12, annotated

| !BstAPI GCANNNNntgc<br>(SEQ ID NO: 2445) | BstBI TTcgaa | BstZ17I GTAtac |
|---|---|---|
| !BtrI CACgtg | Ec11361 GAGctc | EcoRV GATatc |
| !FseI GGCCGGcc | HpaI GTTaac | NdeI CAtatg |
| !NsiI ATGCAt | PacI TTAATtaa | PmeI GTTTaaac |
| !Pm1I CACgtg | PshAI GACNNnngtc<br>(SEQ ID NO: 2446) | RsrII CGgwccg |
| !SacI GAGCTc | SacII CCGCgg | SalI Gtcgac |
| !SbfI CCTGCAgg | SgfI GCGATcgc | SnaBI TACgta |
| !SphI GCATGc | Sse8387I CCTGCAgg | StuI AGGcct |
| !SwaI ATTTaaat | TliI Ctcgag | XcmI CCANNNNNnnnntgg<br>(SEQ ID NO: 2447) |
| !XhoI Ctcgag | | |

!
! cutters
! Enzymes that cut more than 5 times.

| !AgeI Accggt | 6 | | | | |
|---|---|---|---|---|---|
| !BsiHKAI GWGCWc | 9 | | | | |
| !BsrFI Rccggy | 15 | | | | |
| !EarI CTCTTCNnnn<br>(SEQ ID NO: 2448) | 6 | | | | |
| !Eco57I CTGAAG | 7 | | | | |
| !EcoO109I RGgnccy | 7 | | | | |
| !FauI nNNNNNNGCGGG<br>(SEQ ID NO: 2449) | 10 | | | | |
| !HgiAI GWGCWc | 9 | | | | |

! Enzymes that cut from 1 to 5 times.
! $ = DAM site, * = DCM site, & = both
!

| !BssSI Ctcgtg | 1 | 12 | | | |
|---|---|---|---|---|---|
| !-"- Cacgag | 1 | 1703 | | | |
| !BspHI Tcatga | 4 | 43 | 148 | 1156 | 3665$ |
| !AatII GACGTc | 1 | 65 | | | |
| !BciVI GTATCCNNNNNN<br>(SEQ ID NO: 2450) | 2 | 140 | 1667 | | |
| !AvaI Cycgrg | 3 | 319 | 4010 | 5628 | |
| !BcgI gcannnnnntcg<br>(SEQ ID NO: 2451) | 2 | 461 | | 4021$ | |
| !ScaI AGTact | 4 | 505 | 3232 | 3529 | 4573 |
| !PvuI CGATcg | 3 | 616$ | 4027$ | 5176$ | |
| !FspI TGCgca | 2 | 763 | 5196 | | |
| !BglI GCCNNNNnggc<br>(SEQ ID NO: 2452) | 5 | 864 | 3538 | 3694 | 4945 | 5202 |

TABLE 19-continued pM160G12URP12, annotated

| | | | | |
|---|---|---|---|---|
| !BpmI CTGGAG | 1 | 898 | | |
| !BsaI GGTCTCNnnnn (SEQ ID NO: 2453) | 1 | 916 | | |
| !-"- nnnngagacc (SEQ ID NO: 2454) | 2 | 3386 | | |
| !AhdI GACNNNnngtc (SEQ ID NO: 2455) | 2 | 983 | 5019* | |
| !Eam1105I GACNNNnngtc (SEQ ID NO: 2456) | 2 | 983 | 5019* | |
| !AlwNI CAGNNNctg | 2 | 1462 | 2923 | |
| !DrdI GACNNNNnngtc (SEQ ID NO: 2457) | 3 | 1768 | 5562 | 5831 |
| !PciI Acatgt | 1 | 1876 | | |
| !SapI gaagagc | 1 | 1998 | | |
| !PvuII CAGctg | 2 | 2054 | 5146 | |
| !Pf1MI CCANNNNntgg (SEQ ID NO: 2458) | 1 | 2233 | | |
| !HindIII Aagctt | 2 | 2235 | 3655 | |
| !ApaLI Gtgcac | 1 | 2321 | | |
| !PflFI GACNnngtc | 3 | 2340 | 2377 | 4197 |
| !Tth111I GACNnngtc | 3 | 2340 | 2377 | 4197 |
| !BsmFI Nnnnnnnnnnnnnnngtccc (SEQ ID NO: 2459) | 1 | 2485 | | |
| !-"- GGGACNNNNNNNNNNNNnn (SEQ ID NO: 2460) | 2 | 2530 | | |
| !PpuMI RGgwccy | 3 | 2498 | 3024 | 4587 |
| !SanDI GGgwccc | 1 | 2498 | | |
| !EcoRI Gaattc | 2 | 2536 | 5056 | |
| !PstI CTGCAg | 1 | 2560 | | |
| !HincII GTYrac | 1 | 2591 | | |
| !StyI Ccwwgg | 4 | 2633 | 3704 | 4094 | 4361 |
| !BsgI ctgcac | 1 | 2660 | | |
| !-"-GTGCAG | 1 | 5751 | | |
| !BbsI gtcttc | 2 | 2671 | 4108 | |
| !BlpI GCtnagc | 1 | 2868 | | |
| !EspI GCtnagc | 1 | 2868 | | |
| !AccI GTmkac | 1 | 2899 | | |
| !SgrAI CRccggyg | 2 | 2936 | 3585 | |
| !Acc651 Ggtacc | 1 | 2971 | | |
| !KpnI GGTACc | 1 | 2971 | | |
| !BsmBI CGTCTCNnnnn (SEQ ID NO: 2461) | 3 | 3104 | 4077 | 5877 |
| !-"- Nnnnngagacg (SEQ ID NO: 2462) | 1 | 5925 | | |

TABLE 19-continued pM160G12URP12, annotated

| | | | | | |
|---|---|---|---|---|---|
| !Bsu36I CCtnagg | 3 | 3121 | 3310 | 4657* | |
| !NaeI GCCggc | 3 | 3148 | 3699 | 5416 | |
| !NgoMIV Gccggc | 3 | 3148 | 3699 | 5416 | |
| !EagI Cggccg | 4 | 3284 | 3983 | 4397 | 4805 |
| !BspEI Tccgga | 4 | 3453* | 3784 | 4905 | 4959 |
| !SexAI Accwggt | 2 | 3459* | 4665* | | |
| !BseRI NNnnnnnnnnctcctc (SEQ ID NO: 2463) | 4 | 3466* | 4115 | 4634 | 4960* |
| !EcoNI CCTNNnnnagg (SEQ ID NO: 2464) | 3 | 3604 | 3832* | 4167* | |
| !AscI GGcgcgcc | 1 | 3613 | | | |
| !BssHII Gcgcgc | 1 | 3614 | | | |
| !SfiI GGCCNNNNnggcc (SEQ ID NO: 2465) | 1 | 3693 | | | |
| !BtgI Ccrygg | 1 | 3704 | | | |
| !DsaI Ccrygg | 1 | 3704 | | | |
| !NcoI Ccatgg | 1 | 3704 | | | |
| !MfeI Caattg | 1 | 3718 | | | |
| !BstXI CCANNNNNntgg (SEQ ID NO: 2466) | 1 | 3825* | | | |
| !MscI TGGcca | 1 | 3876 | | | |
| !XbaI Tctaga | 1 | 3922 | | | |
| !AflII Cttaag | 1 | 3966 | | | |
| !XmaI Cccggg | 1 | 4010 | | | |
| !NruI TCGcga | 1 | 4030$ | | | |
| !BstEII Ggtnacc | 1 | 4071* | | | |
| !ApaI GGGCCc | 1 | 4098 | | | |
| !BanII GRGCYc | 4 | 4098 | 4381 | 4602 | 5446 |
| !Bsp120I Gggccc | 1 | 4098 | | | |
| !PspOMI Gggccc | 1 | 4098 | | | |
| !NheI Gctagc | 1 | 4116 | | | |
| !KasI Ggcgcc | 3 | 4216 | 4465 | 5217 | |
| !NotI GCggccgc | 1 | 4396 | | | |
| !SpeI Actagt | 1 | 5020* | | | |
| !MluI Acgcgt | 1 | 5045 | | | |
| !BsaAI YACgtr | 1 | 5519 | | | |
| !DraIII CACNNNgtg | 1 | 5519 | | | |
| !PsiI TTAtaa | 1 | 5647 | | | |

!------------------------------------------------------------

(SEQ ID NO: 2467)

1        gacgaaaggg cctcgtgata cgcctatttt tataggttaa tgtcatgata ataatggttt

TABLE 19-continued pM160G12URP12, annotated

| | |
|---|---|
| 61 | cttaGACGTC aggtggcact tttcggggaa atgtgcgcgg aacccctatt tgtttatttt |
| ! | AatII. |
| 121 | tctaaataca ttcaaatatg tatccgctca tgagacaata accctgataa atgcttcaat |
| 181 | aatattgaaa aaggaagagt atgagtattc aacatttccg tgtcgccctt attccctttt |
| 241 | ttgcggcatt ttgccttcct gttttttgctc acccagaaac gctggtgaaa gtaaaagatg |
| 301 | ctgaagatca gttgggtgcc cgagtgggtt acatcgaact ggatctcaac agcggtaaga |
| 361 | tccttgagag ttttcgcccc gaagaacgtt ttccaatgat gagcactttt aaagttctgc |
| 421 | tatgtggcgc ggtattatcc cgtattgacg ccgggcaaga gcaactcggt cgccgcatac |
| 481 | actattctca gaatgacttg gttgagtact caccagtcac agaaaagcat cttacggatg |
| 541 | gcatgacagt aagagaatta tgcagtgctg ccataaccat gagtgataac actgcggcca |
| 601 | acttacttct gacaacgatc ggaggaccga aggagctaac cgcttttttg cacaacatgg |
| 661 | gggatcatgt aactcgcctt gatcgttggg aaccggagct gaatgaagcc ataccaaacg |
| 721 | acgagcgtga caccacgatg cctgtagcaa tggcaacaac gttgcgcaaa ctattaactg |
| 781 | gcgaactact tactctagct tcccggcaac aattaataga ctggatggag gcggataaag |
| 841 | ttgcaggacc acttctgcgc tcggcccttc cggctggctg gtttattgct gataaatCTG |
| ! | BpmI. |
| !901 | GAGccggtga gcgtgggtct cgcggtatca ttgcagcact ggggccagat ggtaagccct |
| | BpmI. |
| 961 | cccgtatcgt agttatctac acgacgggga gtcaggcaac tatggatgaa cgaaatagac |
| 1021 | agatcgctga gataggtgcc tcactgatta agcattggta actgtcagac caagtttact |
| 1081 | catatatact ttagattgat ttaaaacttc attttttaatt taaaaggatc taggtgaaga |
| 1141 | tcctttttga taatctcatg accaaaatcc cttaacgtga gttttcgttc cactgagcgt |
| 1201 | cagaccccgt agaaaagatc aaaggatctt cttgagatcc ttttttctg cgcgtaatct |
| 1261 | gctgcttgca acaaaaaaa ccaccgctac cagcggtggt ttgtttgccg gatcaagagc |
| 1321 | taccaactct ttttccgaag gtaactggct tcagcagagc gcagatacca aatactgttc |
| 1381 | ttctagtgta gccgtagtta ggccaccact tcaagaactc tgtagcaccg cctacatacc |
| 1441 | tcgctctgct aatcctgtta ccagtggctg ctgccagtgg cgataagtcg tgtcttaccg |
| 1501 | ggttggactc aagacgatag ttaccggata aggcgcagcg gtcgggctga acggggggtt |
| 1561 | cgtgcataca gcccagcttg gagcgaacga cctacaccga actgagatac ctacagcgtg |
| 1621 | agctatgaga aagcgccacg cttcccgaag ggagaaaggc ggacaggtat ccggtaagcg |
| 1681 | gcagggtcgg aacaggagag cgcacgaggg agcttccagg gggaaacgcc tggtatcttt |
| 1741 | atagtcctgt cgggtttcgc cacctctgac ttgagcgtcg atttttgtga tgctcgtcag |
| 1801 | gggggcggag cctatggaaa aacgccagca acgcggcctt tttacggttc ctggccttt |
| 1861 | gctggccttt tgctcACATG Ttctttcctg cgttatcccc tgattctgtg ataaccgta |
| ! | PciI... |
| 1921 | ttaccgcctt tgagtgagct gataccgctc gccgcagccg aacgaccgag cgcagcgagt |
| 1981 | cagtgagcga ggaagcgGAA GAGCgcccaa tacgcaaacc gcctctcccc gcgcgttggc |
| ! | SapI.... |
| 2041 | cgattcatta atgcagctgg cacgacaggt ttcccgactg gaaagcgggc agtgagcgca |
| 2101 | acgcaattaa tgtgagttag ctcactcatt aggcaccca ggctttacac tttatgcttc |

TABLE 19-continued pM160G12URP12, annotated

```
2161        cggctcgtat gttgtgtgga attgtgagcg gataacaatt tcacacagga aacagctatg 2221        accatgatta cgccaagctt tggagccttt tttttggaga ttttcaac
```

! M160-G12           LC
(SEQ ID NO: 2468)
!QDIQMTQSPS FLSASVGDRV TITCRASQGI SSYLAWYQQK PGKAPKLLIY AASTLQSGVP        60
!SRFSGSGSGT EFTLTISSLQ PEDFATYYCQ QLNSYPLTFG GGTKVEIK                    108
!
!                   LC signal sequence------------------------------------
!                   1    2    3    4    5    6    7    8    9   10   11   12   13   14   15
!                   M    K    K    L    L    F    A    I    P    L    V    V    P    F    Y 2269                atg  aaa  aaa  tta  tta  ttc  gca  att  cct  tta  gtt  gtt  cct  ttc  tat
!
!                   Signal------        | LC Vkappa----------------------------------
!                   16   17   18   19   20   21   22   23   24   25   26   27   28   29   30
!                   S    H    S    A    Q    D    I    Q    M    T    Q    S    P    S    F 2314                tct  cac  aGT  GCA  Caa  gac  atc  cag  atg  acc  cag  tct  cca  tcc  ttc
!                             ApaLI...
!                   LC Vkappa-----------------------------------------------
!                   31   32   33   34   35   36   37   38   39   40   41   42   43   44   45
!                   L    S    A    S    V    G    D    R    V    T    I    T    C    R    A 2359                ctg  tct  gca  tct  gta  gga  gac  aga  gtc  acc  atc  act  tgc  cgg  gcc
!
!                   LC Vkappa-----------------------------------------------
!                   46   47   48   49   50   51   52   53   54   55   56   57   58   59   60
!                   S    Q    G    I    S    S    Y    L    A    W    Y    Q    Q    K    P 2404                agt  cag  ggc  att  agc  agt  tat  tta  gcc  tgg  tat  cag  caa  aaa  cca
!
!                   LC Vkappa-----------------------------------------------
!                   61   62   63   64   65   66   67   68   69   70   71   72   73   74   75
!                   G    K    A    P    K    L    L    I    Y    A    A    S    T    L    Q 2449                ggg  aaa  gcc  cct  aag  ctc  ctg  atc  tat  gct  gca  tcc  act  ttg  caa
!
!                   LC Vkappa-----------------------------------------------
!                   76   77   78   79   80   81   82   83   84   85   86   87   88   89   90
!                   S    G    V    P    S    R    F    S    G    S    G    S    G    T    E 2494                agt  gGG  GTC  CCa  tca  agg  ttc  agc  ggc  agt  gga  tct  ggg  aca  gaa
!                        SanDI....
!                   LC Vkappa-----------------------------------------------
!                   91   92   93   94   95   96   97   98   99  100  101  102  103  104  105
!                   F    T    L    T    I    S    S    L    Q    P    E    D    F    A    T 2539                ttc  act  ctc  aca  atc  agc  agc  CTG  CAG  cct  gaa  gat  ttt  gca  act
!                                                  PstI...
!                   LC Vkappa-----------------------------------------------
!                   106  107  108  109  110  111  112  113  114  115  116  117  118  119  120
!                   Y    Y    C    Q    Q    L    N    S    Y    P    L    T    F    G    G 2584                tat  tac  tGT  CAA  Cag  ctt  aat  agt  tac  cct  ctc  act  ttc  ggc  gga
!                             HincII..
!
!                   LC Vkappa------------------ | Ckappa----------------------
!                   121  122  123  124  125  126  127  128  129  130  131  132  133  134  135
!                   G    T    K    V    E    I    K    R    T    V    A    A    P    S    V 2629                ggg  acc  aag  gtg  gag  atc  aaa  cga  act  gtg  gct  gca  cca  tct  gtc
!
!                   Ckappa-------------------------------------------------
!                   136  137  138  139  140  141  142  143  144  145  146  147  148  149  150
!                   F    I    F    P    P    S    D    E    Q    L    K    S    G    T    A 2674                ttc  atc  ttc  ccg  cca  tct  gat  gag  cag  ttg  aaa  tct  gga  act  gcc
!
!                   Ckappa-------------------------------------------------
!                   151  152  153  154  155  156  157  158  159  160  161  162  163  164  165
!                   S    V    V    C    L    L    N    N    F    Y    P    R    E    A    K 2719                tct  gtt  gtg  tgc  ctg  ctg  aat  aac  ttc  tat  ccc  aga  gag  gcc  aaa
!
!                   Ckappa-------------------------------------------------
```

TABLE 19-continued pM160G12URP12, annotated

```
         166 167 168 169 170 171 172 173 174 175 176 177 178 179 180
          V   Q   W   K   V   D   N   A   L   Q   S   G   N   S   Q
2764     gta cag tgg aag gtg gat aac gcc ctc caa tcg ggt aac tcc cag Ckappa-----------------------------------------------------
         181 182 183 184 185 186 187 188 189 190 191 192 193 194 195
          E   S   V   T   E   Q   D   S   K   D   S   T   Y   S   L
2809     gag agt gtc aca gag cag gac agc aag gac agc acc tac agc ctc Ckappa-----------------------------------------------------
         196 197 198 199 200 201 202 203 204 205 206 207 208 209 210
          S   S   T   L   T   L   S   K   A   D   Y   E   K   H   K
2854     agc agc acc ctg acG CTG AGC aaa gca gac tac gag aaa cac aaa
                             BlpI.....

Ckappa-----------------------------------------------------
         211 212 213 214 215 216 217 218 219 220 221 222 223 224 225
          V   Y   A   C   E   V   T   H   Q   G   L   S   S   P   V
2899     GTC TAC gcc tgc gaa gtc acc cat cag ggc ctg agt tca ccg gtg
         AccI...

Ckappa---------------------------! URP------------------
         226 227 228 229 230 231 232 233 234 235 236 237 238 239 240
          T   K   S   F   N   R   G   E   C   G   T   A   S   T   A
2944     aca aag agc ttc aac agg gga gag tgt GGT ACC gct tct act gcc
                                             KpnI...

URP--------------------------------------------------------
         241 242 243 244 245 246 247 248 249 250 251 252 253 254 255
          T   T   G   P   A   P   T   E   S   P   A   P   G   P   S
2989     acc act ggt cct gct cct act gaa tcc cct gct ccg ggt cct tct URP--------------------------------------------------------
         256 257 258 259 260 261 262 263 264 265 266 267 268 269 270
          G   A   P   G   S   T   G   P   G   E   P   S   P   S   E
3034     ggt gct cct ggc tct act ggt cct ggt gag ccg agt cct agt gaa URP--------------------------------------------------------
         271 272 273 274 275 276 277 278 279 280 281 282 283 284 285
          A   T   T   P   A   P   G   T   P   S   P   T   S   G   P
3079     gcc acc act cct gct cct ggt act ccg tct cct act tcc ggc cct URP--------------------------------------------------------
         286 287 288 289 290 291 292 293 294 295 296 297 298 299 300
          E   G   A   T   G   E   G   A   A   G   E   P   P   P   S
3124     gag ggt gct acc ggt gaa ggt gct gcc ggc gag cct ccg cct tct URP--------------------------------------------------------
         301 302 303 304 305 306 307 308 309 310 311 312 313 314 315
          G   T   G   P   A   A   A   S   P   G   G   P   P   G   E
3169     ggt act ggt cct gct gct gct tct cct ggt ggc ccg cct ggt gaa URP--------------------------------------------------------
         316 317 318 319 320 321 322 323 324 325 326 327 328 329 330
          T   A   S   G   P   A   S   T   G   G   T   G   S   T   A
3214     act gcc agt ggt cct gct agt act ggt ggc acc ggt tct act gct URP--------------------------------------------------------
         331 332 333 334 335 336 337 338 339 340 341 342 343 344 345
          T   P   T   S   S   A   E   S   P   A   G   T   E   P   S
3259     act cct act tcc tct gct gag tct ccg gcc ggt act gaa cct agt URP--------------------------------------------------------
         346 347 348 349 350 351 352 353 354 355 356 357 358 359 360
          S   G   P   E   E   P   S   E   E   P   A   T   E   A   A
```

TABLE 19-continued pM160G12URP12, annotated

```
3304        agt ggt cct gag gaa cct tct gag gaa ccg gct act gag gct gct
!
!           URP-----------------------------------------------------------
!           361 362 363 364 365 366 367 368 369 370 371 372 373 374 375
!            G   G   T   T   T   E   A   S   G   T   T   G   T   S   E 3349        ggc ggt act act acc gaa gcc tcc ggt act act ggt act tct gag
!
!           URP-----------------------------------------------------------
!           376 377 378 379 380 381 382 383 384 385 386 387 388 389 390
!            T   A   S   P   E   E   A   P   S   A   S   A   T   P 3394        acc gct tct cct gaa gag gaa gct cct agt gct agt gcc act cct
!
!           URP-----------------------------------------------------------
!           391 392 393 394 395 396 397 398 399 400 401 402 403 404 405
!            G   E   T   G   T   P   E   P   G   A   P   G   T   P   P 3439        ggc gag act ggt act ccg gaa cct ggt gct cct ggt act cct ccg
!
!           URP-----------------------------------------------------------
!           406 407 408 409 410 411 412 413 414 415 416 417 418 419 420
!            T   G   A   G   S   S   E   P   A   G   S   G   G   S   G 3484        act ggc gct ggt tct tcc gag cct gct ggt tct ggt ggc tct ggt
!
!           URP-----------------------------------------------------------
!           421 422 423 424 425 426 427 428 429 430 431 432 433 434 435
!            S   T   P   A   S   E   A   S   S   S   P   A   S   T   A 3529        agt act cct gcc agt gag gct tct tcc tct cct gct tct act gct
!
!           URP-----------------------------------------------------------
!           436 437 438 439 440 441 442 443 444 445 446 447 448
!            G   S   S   T   A   G   E   E   P   P   P   .   .
```

(SEQ ID NO: 2470)

```
3574        ggt agt agt acc gcc ggt gag gaa ccg cct cct taa taa
!

3613                        GGCG CGCCtaacca tctatttcaa
!                           AscI.....
!                           BssHII.
```

(SEQ ID NO: 2469)

```
3637        ggaacagtct ta
!

!M160-G12                  HC
```

(SEQ ID NO: 2471)

```
!EVQLLESGGG LVQPGGSLRL SCAASGFTFS HYLMTWVRQA PGKGLEWVSY ISPSGGHTIY    60

!ADSVKGRFTI SRDNSKNTLY LQMNSLRAED TAVYYCARVA RGIAARSRTS YFDYWGQGTL   120

!VTVSSASTKG PSVFPLAPSS KS                                            142

!           HC signal sequence---------------------------------------
!            1   2   3   4   5   6   7   8   9  10  11  12  13  14  15
!            M   K   K   L   L   F   M   I   P   L   V   V   P   F   V 3649        atg aaa aag ctt tta ttc atg atc ccg tta gtt gta ccg ttc gtG
!                                                           SfiI      .
!
!           signal sequence -------------|--- VH--------------------------
!           16  17  18  19  20  21  22  23  24  25  26  27  28  29  30
!            A   Q   P   A   M   A   E   V   Q   L   L   E   S   G   G 3694        GCC CAG CCG GCC atg gcc gaa gtt CAA TTG tta gag tct ggt ggc
!           SfiI................           MfeI...
!                       NcoI....
!
!           VH-----------------------------------------------------------
!           31  32  33  34  35  36  37  38  39  40  41  42  43  44  45
!            G   L   V   Q   P   G   G   S   L   R   L   S   C   A   A
```

TABLE 19-continued pM160G12URP12, annotated

```
3739        ggt ctt gtt cag cct ggt ggt tct tta cgt ctt tct tgc gct gct
!
!           VH---------------------------------------------------------
!            46  47  48  49  50  51  52  53  54  55  56  57  58  59  60
!            S   G   F   T   F   S   H   Y   L   M   T   W   V   R   Q 3784        tcc gga ttc act ttc tct cat tac ctt atg act tgg gtt cgc caa
!
!            61  62  63  64  65  66  67  68  69  70  71  72  73  74  75
!            A   P   G   K   G   L   E   W   V   S   Y   I   S   P   S 3829        gct cct ggt aaa ggt ttg gag tgg gtt tct tat atc tct cct tct
!
!           VH---------------------------------------------------------
!            76  77  78  79  80  81  82  83  84  85  86  87  88  89  90
!            G   G   H   T   I   Y   A   D   S   V   K   G   R   F   T 3874        ggt ggc cat act att tat gct gac tcc gtt aaa ggt cgc ttc act
!
!           VH---------------------------------------------------------
!            91  92  93  94  95  96  97  98  99  100 101 102 103 104 105
!            I   S   R   D   N   S   K   N   T   L   Y   L   Q   M   N 3919        atc TCT AGA gac aac tct aag aat act ctc tac ttg cag atg aac
!               XbaI...
!
!           VH---------------------------------------------------------
!            106 107 108 109 110 111 112 113 114 115 116 117 118 119 120
!            S   L   R   A   E   D   T   A   V   Y   Y   C   A   R   V 3964        agc tta agg gct gag gac acg gcc gtg tat tac tgt gca aga gtg
!
!           VH---------------------------------------------------------
!            121 122 123 124 125 126 127 128 129 130 131 132 133 134 135
!            A   R   G   I   A   A   R   S   R   T   S   Y   F   D   Y 4009        gCC CGG Ggg ata gca gct cga TCG CGA acc agc tac ttt gac tac
!               XmaI....                NruI...
!
!           VH---------------------------------------------------------
!            136 137 138 139 140 141 142 143 144 145 146 147 148 149 150
!            W   G   Q   G   T   L   V   T   V   S   S   A   S   T   K 4054        tgg ggc cag gga acc ctG GTC ACC gtc tca agc gcc tcc acc aaG
!                                   BstEII...             Bsp120I .
!
!            151 152 153 154 155 156 157 158 159 160 161 162 163 164 165
!            G   P   S   V   F   P   L   A   P   S   S   K   T   S 4099        GGC CCa tcg gtc ttc ccG CTA GCa ccc tcc tcc aag agc acc tct
!           Bsp120I.            NheI....
!
!            166 167 168 169 170 171 172 173 174 175 176 177 178 179 180
!            G   G   T   A   A   L   G   C   L   V   K   D   Y   F   P 4144        ggg ggc aca gcg gcc ctg ggc tgc ctg gtc aag gac tac ttc ccc
!
!            181 182 183 184 185 186 187 188 189 190 191 192 193 194 195
!            E   P   V   T   V   S   W   N   S   G   A   L   T   S   G 4189        gaa ccg gtg acg gtg tcg tgg aac tca ggc gcc ctg acc agc ggc
!
!            196 197 198 199 200 201 202 203 204 205 206 207 208 209 210
!            V   H   T   F   P   A   V   L   Q   S   S   G   L   Y   S 4234        gtc cac acc ttc ccg gct gtc cta cag tct agc gga ctc tac tcc
!
!            211 212 213 214 215 216 217 218 219 220 221 222 223 224 225
!            L   S   S   V   V   T   V   P   S   S   S   L   G   T   Q 4279        ctc agc agc gta gtg acc gtg ccc tct tct agc ttg ggc acc cag
!
!            226 227 228 229 230 231 232 233 234 235 236 237 238 239 240
!            T   Y   I   C   N   V   N   H   K   P   S   N   T   K   V
```

TABLE 19-continued pM160G12URP12, annotated

```
4324      acc tac atc tgc aac gtg aat cac aag ccc agc aac acc aag gtg
                                                  URP----------------->
          241 242 243 244 245 246 247 248 249 250 251 252 253 254 255
           D   K   K   V   E   P   K   S   C   A   A   A   S   P   A 4369      gac aag aaa gtt gag ccc aaa tct tgt GCG GCC GCt tct cct gct
                                              NotI......
          256 257 258 259 260 261 262 263 264 265 266 267 268 269 270
           T   A   S   A   S   T   A   P   A   T   A   T   P   E   S 4414      act gct tcc gct tct act gcc ccg gct act gct acc cct gag tct
          271 272 273 274 275 276 277 278 279 280 281 282 283 284 285
           A   E   G   A   T   T   E   T   P   T   T   E   T   P   A 4459      gct gaa ggc gcc act act gag act cct acc act gaa act cct gct
          286 287 288 289 290 291 292 293 294 295 296 297 298 299 300
           E   S   A   S   G   P   P   A   P   S   E   S   A   T   E 4504      gag agt gct agt ggt ccg cct gct cct tct gaa tcc gcc act gag
          301 302 303 304 305 306 307 308 309 310 311 312 313 314 315
           E   S   G   E   A   S   T   S   S   T   A   E   E   G   P 4549      gaa tct ggt gag gct tct acc agt agt act gct gaa gag ggt cct
          316 317 318 319 320 321 322 323 324 325 326 327 328 329 330
           A   E   P   G   S   P   A   P   T   P   A   A   T   P   A 4594      gct gaa ccg ggc tct cct gcc cct act cct gct gct act ccg gct
          331 332 333 334 335 336 337 338 339 340 341 342 343 344 345
           E   T   S   S   E   P   P   E   E   P   G   G   A   G   T 4639      gag acc tcc tct gaa cct cct gag gaa cct ggt ggt gcc ggt act
          346 347 348 349 350 351 352 353 354 355 356 357 358 359 360
           P   A   G   T   T   T   G   A   E   T   E   S   A   T   E 4684      ccg gct ggc act act acc ggt gct gag act gaa tct gct act gag
          361 362 363 364 365 366 367 368 369 370 371 372 373 374 375
           G   G   A   S   S   A   P   A   S   P   T   G   G   A   P 4729      ggt ggt gcc agt agt gct cct gct tct cct act ggc ggt gct cct
          376 377 378 379 380 381 382 383 384 385 386 387 388 389 390
           S   S   G   E   T   T   T   E   G   G   P   A   G   P   A 4774      tcc tct ggt gaa acc act act gag ggt ggc ccg gcc ggt cct gct
          391 392 393 394 395 396 397 398 399 400 401 402 403 404 405
           P   A   T   A   A   P   T   G   G   A   G   G   E   G 4819      cct gct act gct gcc cct acc ggt ggt ggc gct ggt ggt gaa ggt
          406 407 408 409 410 411 412 413 414 415 416 417 418 419 420
           S   A   G   G   T   G   E   E   G   G   G   A   P 4864      tct gct ggc ggt ggt act ggt gag gaa ggc ggt ggt ggt gct ccg
          421 422 423 424 425 426 427 428 429 430 431 432 433 434 435
           E   G   S   G   G   P   E   G   P   T   P   A   T   E 4909      gag ggc agt ggt ggt ggt cct gaa ggc cct act cct gcc act gag
          436 437 438 439 440 441 442 443 444 445 446 447 448 449 450
           A   S   P   E   G   A   P   P   G   S   T   S   T   S   G 4954      gct agt ccg gaa ggt gct cct cct ggt tct acc tcc act tct ggt
          451 452 453 454 455 456 457 458 459 460 461 462 463
           P   G   E   A   A   S   P   T   S   S   P   G   .
```

TABLE 19-continued pM160G12URP12, annotated (SEQ ID NO: 2473)
```
4999         cct ggc gag gct gcc tct ccg ACT AGT agt cct ggt taa
!                                         SpeI...
!
```

(SEQ ID NO: 2472)
```
5038         tga taa
!

5044         aACGC GTgatgaga attcactggc cgtcgtttta caacgtcgtg actgggaaaa
!                  MluI...

5098         ccctggcgtt acccaactta atcgccttgc agcacatccc cctttcgcca gctggcgtaa 5158         tagcgaagag gcccgcaccg atcgccctc ccaacagttg cgcagcctga atggcgaatg 5218         gcgcctgatg cggtattttc tccttacgca tctgtgcggt atttcacacc gcatacgtca 5278         aagcaaccat agtacgcgcc ctgtagcggc gcattaagcg cggcgggtgt ggtggttacg 5338         cgcagcgtga ccgctacact tgccagcgcc ttagcgcccg ctcctttcgc tttcttccct 5398         tcctttctcg ccacgttcgc cggctttccc cgtcaagctc taaatcgggg gctcccttta 5458         gggttccgat ttagtgcttt acggcacctc gaccccaaaa aacttgattt gggtgatggt 5518         tCACGTAgtg ggccatcgcc ctgatagacg gttttcgcc ctttgacgtt ggagtccacg
!            BsaAI.
!             DraIII...

5578         ttctttaata gtggactctt gttccaaact ggaacaacac tcaactctat ctcgggctat 5638         tcttttgatT TATAAgggat tttgccgatt tcggtctatt ggttaaaaaa tgagctgatt
!                 PsiI...

5698         taacaaaaat ttaacgcgaa ttttaacaaa atattaacgt ttacaatttt atggtgcagt 5758         ctcagtacaa tctgctctga tgccgcatag ttaagccagc cccgacaccc gccaacaccc 5818         gctgacgcgc cctgacgggc ttgtctgctc ccggcatccg cttacagaca agctgtgacc 5878         gtctccggga gctgcatgtg tcagaggttt tcaccgtcat caccgaaacg cgcga
```

TABLE 20 unannotated DNA sequence of pM160G12:URP12

LOCUS pM160G12 5932 CIRCULAR
!M160-G12_URP1-2 5926 bp DNA circular
ORIGIN (SEQ ID NO: 2474)
```
  1 GACGAAAGGG CCTCGTGATA CGCCTATTTT TATAGGTTAA TGTCATGATA ATAATGGTTT
 61 CTTAGACGTC AGGTGGCACT TTTCGGGGAA ATGTGCGCGG AACCCCTATT TGTTTATTTT
121 TCTAAATACA TTCAAATATG TATCCGCTCA TGAGACAATA ACCCTGATAA ATGCTTCAAT
181 AATATTGAAA AAGGAAGAGT ATGAGTATTC AACATTTCCG TGTCGCCCTT ATTCCCTTTT
241 TTGCGGCATT TGCCTTCCT GTTTTTGCTC ACCCAGAAAC GCTGGTGAAA GTAAAAGATG
301 CTGAAGATCA GTTGGGTGCC CGAGTGGGTT ACATCGAACT GGATCTCAAC AGCGGTAAGA
361 TCCTTGAGAG TTTTCGCCCC GAAGAACGTT TTCCAATGAT GAGCACTTTT AAAGTTCTGC
421 TATGTGGCGC GGTATTATCC CGTATTGACG CCGGGCAAGA GCAACTCGGT CGCCGCATAC
481 ACTATTCTCA GAATGACTTG GTTGAGTACT CACCAGTCAC AGAAAAGCAT CTTACGGATG
541 GCATGACAGT AAGAGAATTA TGCAGTGCTG CCATAACCAT GAGTGATAAC ACTGCGGCCA
601 ACTTACTTCT GACAACGATC GGAGGACCGA AGGAGCTAAC CGCTTTTTTG CACAACATGG
661 GGGATCATGT AACTCGCCTT GATCGTTGGG AACCGGAGCT GAATGAAGCC ATACCAAACG
```

TABLE 20-continued

| unannotated DNA sequence of pM160G12:URP12 |
|---|

```
 721 ACGAGCGTGA CACCACGATG CCTGTAGCAA TGGCAACAAC GTTGCGCAAA CTATTAACTG
 781 GCGAACTACT TACTCTAGCT TCCCGGCAAC AATTAATAGA CTGGATGGAG GCGGATAAAG
 841 TTGCAGGACC ACTTCTGCGC TCGGCCCTTC CGGCTGGCTG GTTTATTGCT GATAAATCTG
 901 GAGCCGGTGA GCGTGGGTCT CGCGGTATCA TTGCAGCACT GGGGCCAGAT GGTAAGCCCT
 961 CCCGTATCGT AGTTATCTAC ACGACGGGGA GTCAGGCAAC TATGGATGAA CGAAATAGAC
1021 AGATCGCTGA GATAGGTGCC TCACTGATTA AGCATTGGTA ACTGTCAGAC CAAGTTTACT
1081 CATATATACT TTAGATTGAT TTAAAACTTC ATTTTTAATT TAAAAGGATC TAGGTGAAGA
1141 TCCTTTTTGA TAATCTCATG ACCAAAATCC CTTAACGTGA GTTTTCGTTC CACTGAGCGT
1201 CAGACCCCGT AGAAAAGATC AAAGGATCTT CTTGAGATCC TTTTTTTCTG CGCGTAATCT
1261 GCTGCTTGCA ACAAAAAAA CCACCGCTAC CAGCGGTGGT TTGTTTGCCG GATCAAGAGC
1321 TACCAACTCT TTTTCCGAAG GTAACTGGCT TCAGCAGAGC GCAGATACCA AATACTGTTC
1381 TTCTAGTGTA GCCGTAGTTA GGCCACCACT TCAAGAACTC TGTAGCACCG CCTACATACC
1441 TCGCTCTGCT AATCCTGTTA CCAGTGGCTG CTGCCAGTGG CGATAAGTCG TGTCTTACCG
1501 GGTTGGACTC AAGACGATAG TTACCGGATA AGGCGCAGCG GTCGGGCTGA ACGGGGGGTT
1561 CGTGCATACA GCCCAGCTTG GAGCGAACGA CCTACACCGA ACTGAGATAC CTACAGCGTG
1621 AGCTATGAGA AAGCGCCACG CTTCCCGAAG GGAGAAAGGC GGACAGGTAT CCGGTAAGCG
1681 GCAGGGTCGG AACAGGAGAG CGCACGAGGG AGCTTCCAGG GGGAAACGCC TGGTATCTTT
1741 ATAGTCCTGT CGGGTTTCGC CACCTCTGAC TTGAGCGTCG ATTTTTGTGA TGCTCGTCAG
1801 GGGGGCGGAG CCTATGGAAA AACGCCAGCA ACGCGGCCTT TTTACGGTTC CTGGCCTTTT
1861 GCTGGCCTTT TGCTCACATG TTCTTTCCTG CGTTATCCCC TGATTCTGTG ATAACCGTA
1921 TTACCGCCTT TGAGTGAGCT GATACCGCTC GCCGCAGCCG AACGACCGAG CGCAGCGAGT
1981 CAGTGAGCGA GGAAGCGGAA GAGCGCCCAA TACGCAAACC GCCTCTCCCC GCGCGTTGGC
2041 CGATTCATTA ATGCAGCTGG CACGACAGGT TTCCCGACTG GAAAGCGGGC AGTGAGCGCA
2101 ACGCAATTAA TGTGAGTTAG CTCACTCATT AGGCACCCCA GGCTTTACAC TTTATGCTTC
2161 CGGCTCGTAT GTTGTGTGGA ATTGTGAGCG GATAACAATT TCACACAGGA AACAGCTATG
2221 ACCATGATTA CGCCAAGCTT TGGAGCCTTT TTTTTGGAGA TTTTCAACAT GAAAAAATTA
2281 TTATTCGCAA TTCCTTTAGT TGTTCCTTTC TATTCTCACA GTGCACAAGA CATCCAGATG
2341 ACCCAGTCTC CATCCTTCCT GTCTGCATCT GTAGGAGACA GAGTCACCAT CACTTGCCGG
2401 GCCAGTCAGG GCATTAGCAG TTATTTAGCC TGGTATCAGC AAAAACCAGG GAAAGCCCCT
2461 AAGCTCCTGA TCTATGCTGC ATCCACTTTG CAAAGTGGGG TCCCATCAAG GTTCAGCGGC
2521 AGTGGATCTG GGACAGAATT CACTCTCACA ATCAGCAGCC TGCAGCCTGA AGATTTTGCA
2581 ACTTATTACT GTCAACAGCT TAATAGTTAC CCTCTCACTT TCGGCGGAGG GACCAAGGTG
2641 GAGATCAAAC GAACTGTGGC TGCACCATCT GTCTTCATCT TCCCGCCATC TGATGAGCAG
2701 TTGAAATCTG GAACTGCCTC TGTTGTGTGC CTGCTGAATA ACTTCTATCC CAGAGAGGCC
2761 AAAGTACAGT GGAAGGTGGA TAACGCCCTC CAATCGGGTA ACTCCCAGGA GAGTGTCACA
2821 GAGCAGGACA GCAAGGACAG CACCTACAGC CTCAGCAGCA CCCTGACGCT GAGCAAAGCA
2881 GACTACGAGA AACACAAAGT CTACGCCTGC GAAGTCACCC ATCAGGGCCT GAGTTCACCG
2941 GTGACAAAGA GCTTCAACAG GGGAGAGTGT GGTACCGCTT CTACTGCCAC CACTGGTCCT
3001 GCTCCTACTG AATCCCCTGC TCCGGGTCCT TCTGGTGCTC CTGGCTCTAC TGGTCCTGGT
```

TABLE 20-continued unannotated DNA sequence of pM160G12:URP12

```
3061 GAGCCGAGTC CTAGTGAAGC CACCACTCCT GCTCCTGGTA CTCCGTCTCC TACTTCCGGC
3121 CCTGAGGGTG CTACCGGTGA AGGTGCTGCC GGCGAGCCTC CGCCTTCTGG TACTGGTCCT
3181 GCTGCTGCTT CTCCTGGTGG CCCGCCTGGT GAAACTGCCA GTGGTCCTGC TAGTACTGGT
3241 GGCACCGGTT CTACTGCTAC TCCTACTTCC TCTGCTGAGT CTCCGGCCGG TACTGAACCT
3301 AGTAGTGGTC CTGAGGAACC TTCTGAGGAA CCGGCTACTG AGGCTGCTGG CGGTACTACT
3361 ACCGAAGCCT CCGGTACTAC TGGTACTTCT GAGACCGCTT CTCCTGAAGA GGAAGCTCCT
3421 AGTGCTAGTG CCACTCCTGG CGAGACTGGT ACTCCGGAAC TGGTGCTCC TGGTACTCCT
3481 CCGACTGGCG CTGGTTCTTC CGAGCCTGCT GGTTCTGGTG CTCTGGTAG TACTCCTGCC
3541 AGTGAGGCTT CTTCCTCTCC TGCTTCTACT GCTGGTAGTA GTACCGCCGG TGAGGAACCG
3601 CCTCCTTAAT AAGGCGCGCC TAACCATCTA TTTCAAGGAA CAGTCTTAAT GAAAAGCTT
3661 TTATTCATGA TCCCGTTAGT TGTACCGTTC GTGGCCCAGC CGGCCATGGC CGAAGTTCAA
3721 TTGTTAGAGT CTGGTGGCGG TCTTGTTCAG CCTGGTGGTT CTTTACGTCT TTCTTGCGCT
3781 GCTTCCGGAT TCACTTTCTC TCATTACCTT ATGACTTGGG TTCGCCAAGC TCCTGGTAAA
3841 GGTTTGGAGT GGGTTTCTTA TATCTCTCCT TCTGGTGGCC ATACTATTTA TGCTGACTCC
3901 GTTAAAGGTC GCTTCACTAT CTCTAGAGAC AACTCTAAGA ATACTCTCTA CTTGCAGATG
3961 AACAGCTTAA GGGCTGAGGA CACGGCCGTG TATTACTGTG CGAGAGTGGC CCGGGGGATA
4021 GCAGCTCGAT CGCGAACCAG CTACTTTGAC TACTGGGGCC AGGGAACCCT GGTCACCGTC
4081 TCAAGCGCCT CCACCAAGGG CCCATCGGTC TTCCCGCTAG CACCCTCCTC AAGAGCACC
4141 TCTGGGGGCA CAGCGGCCCT GGGCTGCCTG GTCAAGGACT ACTTCCCCGA ACCGGTGACG
4201 GTGTCGTGGA ACTCAGGCGC CCTGACCAGC GGCGTCCACA CCTTCCCGGC TGTCCTACAG
4261 TCTAGCGGAC TCTACTCCCT CAGCAGCGTA GTGACCGTGC CCTCTTCTAG CTTGGGCACC
4321 CAGACCTACA TCTGCAACGT GAATCACAAG CCCAGCAACA CCAAGGTGGA CAAGAAAGTT
4381 GAGCCCAAAT CTTGTGCGGC CGCTTCTCCT GCTACTGCTT CCGCTTCTAC TGCCCCGGCT
4441 ACTGCTACCC CTGAGTCTGC TGAAGGCGCC ACTACTGAGA CTCCTACCAC TGAAACTCCT
4501 GCTGAGAGTG CTAGTGGTCC GCCTGCTCCT TCTGAATCCG CCACTGAGGA ATCTGGTGAG
4561 GCTTCTACCA GTAGTACTGC TGAAGAGGGT CCTGCTGAAC CGGGCTCTCC TGCCCCTACT
4621 CCTGCTGCTA CTCCGGCTGA GACCTCCTCT GAACCTCCTG AGGAACCTGG TGGTGCCGGT
4681 ACTCCGGCTG GCACTACTAC CGGTGCTGAG ACTGAATCTG CTACTGAGGG TGGTGCCAGT
4741 AGTGCTCCTG CTTCTCCTAC TGGCGGTGCT CCTTCCTCTG GTGAAACCAC TACTGAGGGT
4801 GGCCCGGCCG GTCCTGCTCC TGCTACTGCT GCCCCTACCG GTGGTGGCGC TGGTGGTGAA
4861 GGTTCTGCTG GCGGTGGTAC TGGTGAGGAA GGCGGTGGTG GTGCTCCGGA GGGCAGTGGT
4921 GGTGGTCCTG AAGGCCCTAC TCCTGCCACT GAGGCTAGTC GGAAGGTGC TCCTCCTGGT
4981 TCTACCTCCA CTTCTGGTCC TGGCGAGGCT GCCTCTCCGA CTAGTAGTCC TGGTTAATGA
5041 TAAAACGCGT GATGAGAATT CACTGGCCGT CGTTTTACAA CGTCGTGACT GGGAAAACCC
5101 TGGCGTTACC CAACTTAATC GCCTTGCAGC ACATCCCCCT TCGCCAGCT GGCGTAATAG
5161 CGAAGAGGCC CGCACCGATC GCCCTTCCCA ACAGTTGCGC AGCCTGAATG GCGAATGGCG
5221 CCTGATGCGG TATTTTCTCC TTACGCATCT GTGCGGTATT TCACACCGCA TACGTCAAAG
5281 CAACCATAGT ACGCGCCCTG TAGCGGCGCA TTAAGCGCGG CGGGTGTGGT GGTTACGCGC
5341 AGCGTGACCG CTACACTTGC CAGCGCCTTA GCGCCCGCTC CTTTCGCTTT CTTCCCTTCC
```

TABLE 20-continued unannotated DNA sequence of pM160G12:URP12

```
5401 TTTCTCGCCA CGTTCGCCGG CTTTCCCCGT CAAGCTCTAA ATCGGGGCT CCCTTTAGGG
5461 TTCCGATTTA GTGCTTTACG GCACCTCGAC CCCAAAAAAC TTGATTTGGG TGATGGTTCA
5521 CGTAGTGGGC CATCGCCCTG ATAGACGGTT TTTCGCCCTT TGACGTTGGA GTCCACGTTC
5581 TTTAATAGTG GACTCTTGTT CCAAACTGGA ACAACACTCA ACTCTATCTC GGGCTATTCT
5641 TTTGATTTAT AAGGGATTTT GCCGATTTCG GTCTATTGGT TAAAAAATGA GCTGATTTAA
5701 CAAAATTTA ACGCGAATTT TAACAAAATA TTAACGTTTA CAATTTTATG GTGCAGTCTC
5761 AGTACAATCT GCTCTGATGC CGCATAGTTA AGCCAGCCCC GACACCCGCC AACACCCGCT
5821 GACGCGCCCT GACGGGCTTG TCTGCTCCCG GCATCCGCTT ACAGACAAGC TGTGACCGTC
5881 TCCGGGAGCT GCATGTGTCA GAGGTTTTCA CCGTCATCAC CGAAACGCGC GA
```

TABLE 21

Examples of human Glycine Rich Sequences (GRS) for use in designing human-specific URPs

| Accession | Gly (%) | GRS length | Gene length | Hydro-phobics | Predicted Function |
|---|---|---|---|---|---|
| NP_000217 | 62 | 135 | 622 | Yes | keratin 9 |
| NP_631961 | 61 | 73 | 592 | Yes | TBP-associated factor 15 isoform 1 |
| NP_476429 | 65 | 70 | 629 | Yes | keratin 3 |
| NP_000418 | 70 | 66 | 316 | Yes | loricrin, cell envelope |
| NP_056932 | 60 | 66 | 638 | Yes | cytokeratin 2 |

TABLE 22

Additional examples of human Glycine Rich Sequences for use in designing human-specific URPs
(SEQ ID NOS 2475-2557, respectively, in order of appearance)

| Accession | Sequences | Number of amino acids |
|---|---|---|
| NP_006228 | GPGGGGGPGGGGGPGGGGPGGGGGGGPGGGGGGPGGG | 37 |
| NP_787059 | GAGGGGGGGGGGGGSGGGGGGGGAGAGGAGAG | 33 |
| NP_009060 | GGGSGSGGAGGGSGGGSGSGGGGGGAGGGGGG | 32 |
| NP_031393 | GDGGGAGGGGGGGSGGGGSGGGGGGG | 27 |
| NP_005850 | GSGSGSGGGGGGGGGGGSGGGGGG | 25 |
| NP_061856 | GGGRGGRGGGRGGGGRGGGRGGG | 22 |
| NP_787059 | GAGGGGGGGGGGGGSGGGGGGGGAGAGGAGAG | 33 |
| NP_009060 | GGGSGSGGAGGGSGGGSGSGGGGGGAGGGGGG | 32 |
| NP_031393 | GDGGGAGGGGGGGSGGGGSGGGGGGG | 27 |
| NP_115818 | GSGGSGGSGGGPGPGPGGGGG | 21 |
| XP_376532 | GEGGGGGEGGGAGGGSG | 18 |
| NP_065104 | GGGGGGGGDGGG | 12 |

GGGSGSGGAGGGSGGGSGGGGGGAGGGGGGSGGGSGTAGGHSG

POU domain, class 4, transcription factor 1 [Homo sapiens]

GPGGGGGPGGGGPGGGGPGGGGGGPGGGGGPGGG

YEATS domain containing 2 [Homo sapiens]

TABLE 22-continued

Additional examples of human Glycine Rich Sequences for
use in designing human-specific URPs
(SEQ ID NOS 2475-2557, respectively, in order of appearance)

| Accession | Sequences | Number of amino acids |
|---|---|---|

GGSGAGGGGGGGGGGSGSGGGGSTGGGGGTAGGG

AT rich interactive domain 1B (SWI1-like) isoform 3; BRG1-binding protein ELD/OSA1; Eld (eyelid)/Osa protein [Homo sapiens]

GAGGGGGGGGGGGGSGGGGGGGGAGAGGAGAG

AT rich interactive domain 1B (SWI1-like) isoform 2; BRG1-binding protein ELD/OSA1; Eld (eyelid)/Osa protein [Homo sapiens]

GAGGGGGGGGGGGSGGGGGGGAGAGGAGAG

AT rich interactive domain 1B (SWI1-like) isoform 1; BRG1-binding protein ELD/OSA1; Eld (eyelid)/Osa protein [Homo sapiens]

GAGGGGGGGGGGGGSGGGGGGGAGAGGAGAG purine-rich element binding protein A; purine-rich single-stranded DNA-binding protein alpha; transcriptional activator protein PUR-alpha [Homo sapiens]

GHPGSGSGSGGGGGGGGGGGSGGGGGAPGG regulatory factor X1; trans-acting regulatory factor 1; enhancer factor C; MHC class II regulatory factor RFX [Homo sapiens]

GGGGSGGGGGGGGGGGGSGSTGGGGSGAG bromo domain-containing protein disrupted in leukemia [Homo sapiens]

GGRGRGGRGRGSRGRGGGGTRGRGRGRGGRG unknown protein [Homo sapiens]

GSGGSGGSGGGPGPGPGGGGGPSGSGSGPG

PREDICTED: hypothetical protein XP_059256 [Homo sapiens]

GGGGGGGGGGGRGGGGRGGGRGGGGEGGG zinc finger protein 281; ZNP-99 transcription factor [Homo sapiens]

GGGGTGSSGGSGSGGGGSGGGGGGSSG

RNA binding protein (autoantigenic, hnRNP-associated with lethal yellow) short isoform; RNA-binding protein (autoantigenic); RNA- binding protein (autoantigenic, hnRNP-associated with lethal yellow) [Homo sapiens]

GDGGGAGGGGGGGSGGGGSGGGGGG signal recognition particle 68 kDa [Homo sapiens]

GGGGGGGSGGGGSGGGGSGGGRGAGG

KIAA0265 protein [Homo sapiens]

GGGAAGAGGGGSGAGGGSGGSGGRGTG engrailed homolog 2; Engrailed-2 [Homo sapiens]

GAGGGRGGGAGGEGGASGAEGGGGAGG

RNA binding protein (autoantigenic, hnRNP-associated with lethal yellow) long isoform; RNA-binding protein (autoantigenic); RNA-binding protein (autoantigenic, hnRNP-associated with lethal yellow) [Homo sapiens]

GDGGGAGGGGGGSGGGGSGGGGGG androgen receptor; dihydrotestosterone receptor [Homo sapiens]

GGGGGGGGGGGGGGGGGGGGGEAG homeo box D11; homeo box 4F; Hox-4.6, mouse, homolog of; homeobox pro- tein

TABLE 22-continued

Additional examples of human Glycine Rich Sequences for use in designing human-specific URPs
(SEQ ID NOS 2475-2557, respectively, in order of appearance)

| Accession | Sequences | Number of amino acids |
|---|---|---|

Hox-D11 [Homo sapiens]

GGGGGGSAGGGSSGGGPGGGGGAGG frizzled 8; frizzled (Drosophila) homolog 8 [Homo sapiens]

GGGGGPGGGGGGPGGGGGPGGGG ocular development-associated gene [Homo sapiens]

GRGGAGSGGAGSGAAGGTGSSGGGG homeo box B3; homeo box 2G; homeobox protein Hox-B3 [Homo sapiens]

GGGGGGGGGGGSGGSGGGGGGGGGG chromosome 2 open reading frame 29 [Homo sapiens]

GGSGGGRGGASGPGSGSGGPGGPAG

DKFZP564F0522 protein [Homo sapiens]

GGHHGDRGGGRGGRGGRGGRGGRAG

PREDICTED: similar to Homeobox even-skipped homolog protein 2 (EVX-2) [Homo sapiens]

GSRGGGGGGGGGGGGGGAGAGGG ras homolog gene family, member U; Ryu GTPase; Wnt-1 responsive Cdc42 homolog;
2310026M05Rik; GTP-binding protein like 1; CDC42-like GTPase [Homo sapiens]

GGRGGRGPGEPGGRGRAGGAEGRG scratch 2 protein; transcriptional repressor scratch 2; scratch (drosophila homolog)
2, zinc finger protein [Homo sapiens]

GGGGGDAGGSGDAGGAGGRAGRAG nucleolar protein family A, member 1; GAR1 protein [Homo sapiens]

GGGRGGRGGGRGGGGRGGGRGGG keratin 1; Keratin-1; cytokeratin 1; hair alpha protein [Homo sapiens]

GGSGGGGGGSSGGRGSGGGSSGG hypothetical protein Fl131413 [Homo sapiens]

GSGPGTGGGGSGSGGGGGSGGG one cut domain, family member 2; onecut 2 [Homo sapiens]

GARGGGSGGGGGGGGGGGGGPG

POU domain, class 3, transcription factor 2 [Homo sapiens]

GGGGGGGGGGGGGGGGGGGGDG

PREDICTED: similar to THO complex subunit 4 (Tho4) (RINA and export factor
binding protein 1) (REF1-I) (Ally of AML-1 and LEF-1) (Aly/REF) [Homo sapiens]

GGTRGGTRGGTRGGDRGRGRGAG

PREDICTED: similar to THO complex subunit 4 (Tho4) (RNA and export factor binding
protein 1) (REF1-I) (Ally of AML-1 and LEF-1) (Aly/REF) [Homo sapiens]

GGTRGGTRGGTRGGDRGRGRGAG

POU domain, class 3, transcription factor 3 [Homo sapiens]

GAGGGGGGGGGGGGGAGGGGGG nucleolar protein family A, member 1; GAR1 protein [Homo sapiens]

TABLE 22-continued

Additional examples of human Glycine Rich Sequences for
use in designing human-specific URPs
(SEQ ID NOS 2475-2557, respectively, in order of appearance)

| Accession | Sequences | Number of amino acids |
|---|---|---|

GGGRGGRGGGRGGGGRGGGRGGG fibrillarin; 34-kD nucleolar scleroderma antigen; RNA, U3 small nucleolar interacting protein 1 [Homo sapiens]

GRGRGGGGGGGGGGGGGRGGGG zinc finger protein 579 [Homo sapiens]

GRGRGRGRGRGRGRGRGRGGAG calpain, small subunit 1; calcium-activated neutral proteinase; calpain, small polypeptide; calpain 4, small subunit (30K); calcium-dependent protease, small subunit [Homo sapiens]

GAGGGGGGGGGGGGGGGGGGG keratin 9 [Homo sapiens]

GGGSGGGHSGGSGGGHSGGSGG forkhead box D1; forkhead-related activator 4;
Forkhead, homolog-like 8; forkhead (Drosophila)-like 8 [Homo sapiens]

GAGAGGGGGGGAGGGGSAGSG

PREDICTED: similar to RIKEN cDNA C230094B15 [Homo sapiens]

GGPGTGSGGGGAGTGGGAGGPG

GGGGGGGGGAGGAGGAGSAGGG cadherin 22 precursor; ortholog of rat PB-cadherin [Homo sapiens]

GGDGGGSAGGGAGGGSGGGAG

AT-binding transcription factor 1; AT motif-binding factor 1 [Homo sapiens]

GGGGGGSGGGGGGGGGGGGGG eomesodermin; t box, brain, 2; eomesodermin (Xenopus laevis) homolog [Homo sapiens]

GPGAGAGSGAGGSSGGGGGPG phosphatidylinositol transfer protein, membrane-associated 2; PYK2 N- terminal domain-interacting receptor 3; retinal degeneration B alpha 2 (Drosophila) [Homo sapiens]

GGGGGGGGGGSGGGGSSGG sperm associated antigen 8 isoform 2; sperm membrane protein 1 [Homo sapiens]

GSGSGPGPGSGPGSGPGHGSG

PREDICTED: RNA binding motif protein 27 [Homo sapiens]

GPGPGPGPGPGPGPGPGPGPG

AP1 gamma subunit binding protein 1 isoform 1; gamma-synergin; adaptor-related protein complex 1 gamma subunit-binding protein 1 [Homo sapiens]

GAGSGGGGAAGAGAGSAGGGG

AP1 gamma subunit binding protein 1 isoform 2; gamma-synergin; adaptor-related protein complex 1 gamma subunit-binding protein 1 [Homo sapiens]

GAGSGGGGAAGAGAGSAGGGG ankyrin repeat and sterile alpha motif domain containing 1; ankyrin repeat and SAM domain containing 1 [Homo sapiens]

TABLE 22-continued

Additional examples of human Glycine Rich Sequences for
use in designing human-specific URPs
(SEQ ID NOS 2475-2557, respectively, in order of appearance)

| Accession | Sequences | Number of amino acids |
|---|---|---|

GGGGGGGSGGGGGGSGGGGGG methyl-CpG binding domain protein 2 isoform 1 [Homo sapiens]

GRGRGRGRGRGRGRGRGRGRG triple functional domain (PTPRF interacting) [Homo sapiens]

GGGGGGGSGGSGGGGGSGGGG forkhead box D3 [Homo sapiens

GGEEGGASGGGPGAGSGSAGG sperm associated antigen 8 isoform 1; sperm membrane protein 1 [Homo sapiens]

GSGSGPGPGSGPGSGPGHGSG methyl-CpG binding domain protein 2 testis-specific isoform [Homo sapiens]

GRGRGRGRGRGRGRGRGRG cell death regulator aven; programmed cell death 12 [Homo sapiens]

GGGGGGGGDGGGRRGRGRGRG regulator of nonsense transcripts 1; delta helicase; up-frameshift mutation 1 homolog
(S. cerevisiae); nonsense mRNA reducing factor 1; yeast Upflp homolog [Homo sapiens]

GGPGGPGGGGAGGPGGAGAG small conductance calcium-activated potassium channel protein 2 isoform a;
apamin-sensitive small-conductance Ca2+-activated potassium channel [Homo sapiens]

GTGGGGSTGGGGGGGSGHG

SRY (sex determining region Y)-box 1; SRY-related HMG-box gene 1
[Homo uz,1/43 sapiens]

GPAGAGGGGGGGGGGGGGG transcription factor 20 isoform 2; stromelysin-1 platelet-derived growth factor-responsive
element binding protein; stromelysin 1 PDGF- responsive element-binding protein;
SPRE-binding protein; nuclear factor SPBP [Homo sapiens]

GGTGGSSGSSGSGSGGGRRG transcription factor 20 isoform 1; stromelysin-1 platelet-derived growth factor-responsive
element binding protein; stromelysin 1 PDGF- responsive element-binding protein;
SPRE-binding protein; nuclear factor SPBP [Homo sapiens]

GGTGGSSGSSGSGSGGGRRG

Ras-interacting protein 1 [Homo sapiens]

GSGTGTTGSSGAGGPGTPGG

BMP-2 inducible kinase isoform b [Homo sapiens]

GGSGGGAAGGGAGGAGAGAG

BMP-2 inducible kinase isoform a [Homo sapiens]

GGSGGGAAGGGAGGAGAGAG forkhead box C1; forkhead-related activator 3;
Forkhead, drosophila, homolog-like 7; forkhead (Drosophila)-like 7;
iridogoniodysgenesis type 1 [Homo sapiens]

GSSGGGGGAGAAGGAGGAG splicing factor p54; arginine-rich 54 kDa nuclear protein [Homo sapiens]

TABLE 22-continued

Additional examples of human Glycine Rich Sequences for
use in designing human-specific URPs
(SEQ ID NOS 2475-2557, respectively, in order of appearance)

| Accession | Sequences | Number of amino acids |
|---|---|---|

GPGPSGGPGGGGGGGGGGG v-maf musculoaponeurotic fibrosarcoma oncogene homolog; Avian musculoaponeurotic
fibrosarcoma (MAF) protooncogene; v-maf musculo- aponeurotic fibrosarcoma (avian)
oncogene homolog [Homo sapiens]

GGGGGGGGGGGGGGAAGAGG
small nuclear ribonucleoprotein D1 polypeptide 16 kDa; snRNP core protein D1; Sm-D
autoantigen; small nuclear ribonucleoprotein D1 polypeptide (16 kD) [Homo sapiens]

GRGRGRGRGRGRGRGRGRGG hypothetical protein H41 [Homo sapiens]

GSAGGSSGAAGAAGGGAGAG

SEQUENCE LISTING (2581 sequences)

SEQ ID NO: 1 - protein, 619 aa, Homo sapiens
GCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 2 - protein, 638 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 3 - DNA, 2252 bp, Homo sapiens
agaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcaaaaaa

SEQ ID NO: 4 - protein, 638 aa, Mus musculus
MILFNRVGYFVSLFATVSCGCMTQLYKNTFFRGGDLAAIYTPDAQYCQKMCTFHPRCLLFSFLAVTPPKETNKRFGCFMKESITGTLPRIHRTGAISGHSLKQCGHQISACHRDIYKGLDMRGSNFNISKTDNIEECQKLCTNNFHCQFFTYATSAFYRPEYRKKCLLKHSASGTPTSIKSADNLVSGFSLKSCALSEIGCPMDIFQHSAFADLNVSQVITPDAFVCRTICTFHPNCLFFTFYTNEWETESQRNVCFLKTSKSGRPSPPIPQENAISGYSLLTCRKTRPEPCHSKIYSGVDFEGEELNVTFVQGADVCQETCTKTIRCQFFIYSLLPQDCKEEGCKCSLRLSTDGSPTRITYGMQGSSGYSLRLCKLVDSPDCTTKINARIVGGTNASLGEWPWQVSLQVKLVSQTHLCGGSIIGRQWVLTAAHCFDGIPYPDVWRIYGGILSLSEITKETPSSRIKELIIHQEYKVSEGNYDIALIKLQTPLNYTEFQKPICLPSKADTNTIYTNCWVTGWGYTKEQGETQNILQKATIPLVPNEECQKKYRDYVINKQMICAGYKEGGTDACKGDSGGPLVCKHSGRWQLVGITSWGEGCGRKDQPGVYTKVSEYMDWILEKTQSSDVRALETSSA

SEQ ID NO: 5 - DNA, 2472 bp, Mus musculus
agaccgccctcggtgccatattcagagggcttgaagaccatcttcatgtgaagactccctctcctccagaaccacaacgtgaccatccttccaggatgattttattcaaccgagtgggttattttgtttccttgtttgctaccgtctcctgtgggtgtatgactcaactgtataaaaataccttcttcagaggtggggatctagctgccatctacaccccagatgcccagtactgtcagaagatgtgcacttttcaccccaggtgcctgctgttcagctttctcgccgtgactccacccaaagagacaaataaacggtttggttgcttcatgaaagagagcattacagggactttgccaagaatacaccggacaggggccatttctggtcattctttaaagcagtgtggccatcaaataagtgcttgccaccgagacatatacaaaggacttgatatgagagggtccaactttaatatctctaagaccgacaatattgaagaatgccagaaactgtgcacaaataattttcactgccaatttttcacatatgctacaagtgcattttacagaccagagtaccggaagaagtgcctgctgaagcacagtgcaagcggaacacccaccagcataaagtcagcggacaacctggtgtctggattctcactgaagtcctgtgcgctttcggagataggttgccccatggatattttccagcactctgcctttgcagacctgaatgtaagccaggtcatcacccccgatgcctttgtgtgtcgcaccatctgcaccttccatcccaactgccttttcttcacgttctacacgaatgaatgggagacagaatcacagagaaatgtttgttttcttaagacgtctaaaagtggaagaccaagtccccctattcctcaagaaaacgctatatctggatatagtctcctcacctgcagaaaaactcgccctgaaccctgccattccaaaatttactctggagttgactttgaaggggaagaactgaatgtgaccttcgtgcaaggagcagatgtctgccaagagacttgtacaaagacaatccgctgccagttttttatttactccttactcccccaagactgcaaggaggaggggtgtaaatgttccttaaggttatccacagatggctccccaactaggatcacctatggcatgcaggggagctccggttattctctgagattgtgtaaacttgtggacagccctgactgtacaacaaaaataaatgcacgtattgtgggaggaacaaacgcttctttaggggagtggccatggcaggtcagcctgcaagtgaagctggtatctcagacccatttgtgtggagggtccatcattggtcgccaatgggtactgacagctgcccattgctttgatggaattccctatccagatgtgtggcgtatatatggcggaattcttagtctgtccgagattacgaaagaaacgccttcctcgagaataaaggagcttattattcatcaggaatacaaagtctcagaaggcaattatgatattgccttaataaagcttcagacgcccctgaattatactgaattccaaaaaccaatatgcctgccttccaaagctgacacaaatacaatttataccaactgttgggtgactggatggggctacacgaaggaacaaggtgaaacgcaaaatattctacaaaaggctactattcctttggtaccaaatgaagaatgccagaaaaaatacagagattatgttataaacaagcagatgatctgtgctggctacaaagaaggcggaacagacgcttgtaagggagattccggtggccccttagtctgtaaacacagtggacggtggcagttggtgggtatcaccagctggggtgaaggctgcgcccgcaaggaccaaccaggagtctacaccaaagtttctgagtacatggactggatattggagaagacacagagcagtgatgtaagagctctggagacatcttcagcctgaggaggctgggtaccaaggaggaagaacccagctggctttaccacctgccctcaaggcaaactagagctccaggattctcggctgtaaaatgttgataatggtgtctacctcacatccgtatcattggattgaaaattcaagtgtagatatagttgctgaagacagcgttttgctcaagtgtgtttcctgccttgagtcacaggagctccaatgggagcattacaaagatcaccaagcttgttaggaaagagaatgatcaaagggttttattaggtaatgaaatgtctagatgtgatgcaattgaaaaaaagaccccagattctagcacagtccttgggaccattctcatgtaactgttgactctggacctcagcagatctcagagttacctgtccacttctgacatttgtttattagagcctgatgctattctttcaagtggagcaaaaaaaaaaaaaaa

SEQ ID NO: 6 - protein, 638 aa, Rattus norvegicus
MILFKQVGYFVSLFATVSCGCLSQLYANTFFRGGDLAAIYTPDAQHCQKMCTFHPRCLLFSFLAVSPTKETDKRFGCFMKESITGTLPRIHRTGAISGHSLKQCGHQLSACHQDIYEGLDMRGSNFNISKTDSIEECQKLCTNNIHCQFFTYATKAFHRPEYRKSCLLKRSSSGTPTSIKPVDNLVSGFSLKSCALSEIGCPMDIFQHFAFADLNVSHVVTPDAFVCRTVCTFHPNCLFFTFYTNEWETESQRNVCFLKTSKSGRPSPPIIQENAVSGYSLFTCRKARPEPCHFKIYSGVAFEGEELNATFVQGADACQETCTKTIRCQFFTYSLLPQDCKAEGCKCSLRLSTDGSPTRITYEAQGSSGYSLRLCKVVESSDCTTKINARIVGGTNSSLGEWPWQVSLQVKLVSQNHMCGGSIIGRQWILTAAHCFDGIPYPDVWRIYGGILNLSEITNKTPFSSIKELIIHQKYKMSEGSYDIALIKLQTPLNYTEFQKPICLPSKADTNTIYTNCWVTGWGYTKERGETQNILQKATIPLVPNEECQKKYRDYVITKQMICAGYKEGGIDACKGDSGGPLVCKHSGRWQLVGITSWGEGCARKEQPGVYTKVAEYIDWILEKIQSSKERALETSPA

SEQ ID NO: 7 - DNA, 2513 bp, Rattus norvegicus
tgaagactagcttcatgtgaagactccttctcctccagcagcacaaagcaaccatccttccaggatgattttattcaaacaagtgggttattttgtttccttgttcgctacagtttcctgtgggtgtctgtcacaactgtatgcaaataccttcttcagaggtggggatctggctgccatctacaccccggatgcccagcactgtcagaagatgtgcacgtttcaccccaggtgcctgctcttcagcttccttgccgtgagtccaaccaaggagacagataaaaggtttgggtgcttcatgaaagagagcattacagggactttgccaagaatacaccggacaggggccatttctggtcattctttaaaacagtgtggccatcaattaagtgcttgccaccaagacatatacgaaggactggatatgagagggtccaactttaatatatctaagaccgacagtattgaagaatgccagaaactgtgcacaaataatattcactgccaatttttcacatatgctacaaaagcatttcacagaccagagtacaggaagagttgcctgctgaagcgcagttcaagtggaacgcccaccagtataaagccagtggacaacctggtgtctggattctcactgaagtcctgtgctctctcagagatcggttgccccatggatattttccagcactttgcctttgcagacctgaatgtaagccatgtcgtcacccccgatgccttcgtgtgtcgcaccgtttgcaccttccatcccaactgcctcttcttcacattctacacgaatgagtgggagacggaatcacagaggaatgtttgttttcttaagacatctaaaagtggaagaccaagtccccctattattcaagaaaatgctgtatctggatacagtctcttcacctgcagaaaagctcgccctgaaccctgccatttcaagatttactctggagttgccttcgaaggggaagaactgaacgcgaccttcgtgcagggagcagatgcgtgccaagagacttgtacaaagaccatccgctgtcagttttttacttactcattgcttccccaagactgcaaggcagaggggtgtaaatgttccttaaggttatccacggatggctctccaactaggatcacctatgaggcacaggggagctctggttattctctgagactgtgtaaagttgtggagagctctgactgtacgacaaaaataaatgcacgtattgtgggaggaacaaactcttctttaggagagtggccatggcaggtcagcctgcaagtaaagttggtttctcagaatcatatgtgtggagggtccatcattggacgccaatggatactgacggctgcccattgctttgatgggattccctatccagacgtgtggcgtatatatggcgggattcttaatctgtcagagattacaaacaaaacgcctttctcaagtataaaggagcttattattcatcagaaatacaaaatgtcagaaggcagttacgatattgccttaataaagcttcagacaccgttgaattatactgaattccaaaaaccaatatgcctgccttccaaagctgacacaaatacaatttataccaactgctgggtgactggatggggctacacaaaggaacgaggtgagacccaaaatattctacaaaaggcaactattcccttggtaccaaatgaagaatgccagaaaaaatatagagattatgttataaccaagcagatgatctgtgctggctacaaagaaggtggaatagatgcttgtaagggagattccggtggccccttagtttgcaaacatagtggaaggtggcagttggtgggtatcaccagctggggcgaaggctgtgcccgcaaggagcaaccaggagtctacaccaaagttgctgagtacattgactggatattggagaagatacagagcagcaaggaaagagctctggagacatctccagcatgaggaggctgggtactgatggggaagagcccagctggcaccagctttaccacctgccctcaagtcctactagagctccagagttctcttctgcaaaatgtcgatagtggtgtctacctcgcatccttaccataggattaaaagtccaaatgtagacacagttgctaaagacagcgccatgctcaagcgtgcttcctgccttgagcaacaggaacgccaatgagaactatccaaagattaccaagcctgtttggaaataaaatggtcaaaggatttttattaggtagtgaaattaggtagttgtccttggaaccattctcatgtaactgttgactctggacctcagcagatcacagttaccttctgtccacttctgacatttgtgtactggaacctgatgctgttcttccacttggagcaaagaactgagaaacctggttctatccattgggaaaaagagatctttgtaacatttcctttacaataaaaagatgttctacttggacttgaaaaaaaaaaaaaaaaaaaaaaaaaa

SEQ ID NO: 8 - protein, 40 aa, Artificial Sequence
  Description of Artificial Sequence: Synthetic polypeptide
  MOD_RES (2)..(2): Ser, Asp, Glu, Thr or Pro
  MOD_RES (4)..(4): Ser, Asp, Glu, Thr or Pro
  MOD_RES (6)..(6): Ser, Asp, Glu, Thr or Pro
  MOD_RES (8)..(8): Ser, Asp, Glu, Thr or Pro
  MOD_RES (10)..(10): Ser, Asp, Glu, Thr or Pro
  MOD_RES (12)..(12): Ser, Asp, Glu, Thr or Pro
  MOD_RES (14)..(14): Ser, Asp, Glu, Thr or Pro
  MOD_RES (16)..(16): Ser, Asp, Glu, Thr or Pro
  MOD_RES (18)..(18): Ser, Asp, Glu, Thr or Pro
  MOD_RES (20)..(20): Ser, Asp, Glu, Thr or Pro
  MOD_RES (22)..(22): Ser, Asp, Glu, Thr or Pro
  MOD_RES (24)..(24): Ser, Asp, Glu, Thr or Pro
  MOD_RES (26)..(26): Ser, Asp, Glu, Thr or Pro
  MOD_RES (28)..(28): Ser, Asp, Glu, Thr or Pro
  MOD_RES (30)..(30): Ser, Asp, Glu, Thr or Pro
  MOD_RES (32)..(32): Ser, Asp, Glu, Thr or Pro
  MOD_RES (34)..(34): Ser, Asp, Glu, Thr or Pro
  MOD_RES (36)..(36): Ser, Asp, Glu, Thr or Pro
  MOD_RES (38)..(38): Ser, Asp, Glu, Thr or Pro
  MOD_RES (40)..(40): Ser, Asp, Glu, Thr or Pro
GXGXGXGXGXGXGXGXGXGXGXGXGXGXGXGXGXGXGXGX

SEQ ID NO: 9 - protein, 39 aa, Artificial Sequence
  Description of Artificial Sequence: Synthetic polypeptide
  MOD_RES (3)..(3): Ser, Asp, Glu, Thr or Pro
  MOD_RES (6)..(6): Ser, Asp, Glu, Thr or Pro
  MOD_RES (9)..(9): Ser, Asp, Glu, Thr or Pro
  MOD_RES (12)..(12): Ser, Asp, Glu, Thr or Pro
  MOD_RES (15)..(15): Ser, Asp, Glu, Thr or Pro
  MOD_RES (18)..(18): Ser, Asp, Glu, Thr or Pro
  MOD_RES (21)..(21): Ser, Asp, Glu, Thr or Pro
  MOD_RES (24)..(24): Ser, Asp, Glu, Thr or Pro
  MOD_RES (27)..(27): Ser, Asp, Glu, Thr or Pro
  MOD_RES (30)..(30): Ser, Asp, Glu, Thr or Pro
  MOD_RES (33)..(33): Ser, Asp, Glu, Thr or Pro
  MOD_RES (36)..(36): Ser, Asp, Glu, Thr or Pro
  MOD_RES (39)..(39): Ser, Asp, Glu, Thr or Pro
GGXGGXGGXGGXGGXGGXGGXGGXGGXGGXGGXGGXGGX

SEQ ID NO: 10 - protein, 40 aa, Artificial Sequence
  Description of Artificial Sequence: Synthetic polypeptide
  MOD_RES (4)..(4): Ser, Asp, Glu, Thr or Pro
  MOD_RES (8)..(8): Ser, Asp, Glu, Thr or Pro
  MOD_RES (12)..(12): Ser, Asp, Glu, Thr or Pro
  MOD_RES (16)..(16): Ser, Asp, Glu, Thr or Pro
  MOD_RES (20)..(20): Ser, Asp, Glu, Thr or Pro
  MOD_RES (24)..(24): Ser, Asp, Glu, Thr or Pro
  MOD_RES (28)..(28): Ser, Asp, Glu, Thr or Pro
  MOD_RES (32)..(32): Ser, Asp, Glu, Thr or Pro
  MOD_RES (36)..(36): Ser, Asp, Glu, Thr or Pro
  MOD_RES (40)..(40): Ser, Asp, Glu, Thr or Pro
GGGXGGGXGGGXGGGXGGGXGGGXGGGXGGGXGGGXGGGX

SEQ ID NO: 11 - protein, 40 aa, Artificial Sequence
  Description of Artificial Sequence: Synthetic polypeptide
  MOD_RES (5)..(5): Ser, Asp, Glu, Thr or Pro
  MOD_RES (10)..(10): Ser, Asp, Glu, Thr or Pro
  MOD_RES (15)..(15): Ser, Asp, Glu, Thr or Pro
  MOD_RES (20)..(20): Ser, Asp, Glu, Thr or Pro
  MOD_RES (25)..(25): Ser, Asp, Glu, Thr or Pro
  MOD_RES (30)..(30): Ser, Asp, Glu, Thr or Pro
  MOD_RES (35)..(35): Ser, Asp, Glu, Thr or Pro
  MOD_RES (40)..(40): Ser, Asp, Glu, Thr or Pro
GGGGXGGGGXGGGGXGGGGXGGGGXGGGGXGGGGXGGGGX

SEQ ID NO: 12 - protein, 315 aa, Artificial Sequence
  Description of Artificial Sequence: Synthetic polypeptide
  MISC_FEATURE (1)..(20): This region may encompass 1-20 Gly residues
  MOD_RES (21)..(21): Ser, Asp, Glu, Thr or Pro
  MISC_FEATURE (22)..(41): This region may encompass 1-20 Gly residues
  MOD_RES (42)..(42): Ser, Asp, Glu, Thr or Pro
  MISC_FEATURE (43)..(62): This region may encompass 1-20 Gly residues
  MOD_RES (63)..(63): Ser, Asp, Glu, Thr or Pro
  MISC_FEATURE (64)..(83): This region may encompass 1-20 Gly residues
  MOD_RES (84)..(84): Ser, Asp, Glu, Thr or Pro
  MISC_FEATURE (85)..(104): This region may encompass 1-20 Gly residues
  MOD_RES (105)..(105): Ser, Asp, Glu, Thr or Pro
  MISC_FEATURE (106)..(125): This region may encompass 1-20 Gly residues
  MOD_RES (126)..(126): Ser, Asp, Glu, Thr or Pro
  MISC_FEATURE (127)..(146): This region may encompass 1-20 Gly residues
  MOD_RES (147)..(147): Ser, Asp, Glu, Thr or Pro
  MISC_FEATURE (148)..(167): This region may encompass 1-20 Gly residues
  MOD_RES (168)..(168): Ser, Asp, Glu, Thr or Pro
  MISC_FEATURE (169)..(188): This region may encompass 1-20 Gly residues
  MOD_RES (189)..(189): Ser, Asp, Glu, Thr or Pro
  MISC_FEATURE (190)..(209): This region may encompass 1-20 Gly residues
  MOD_RES (210)..(210): Ser, Asp, Glu, Thr or Pro
  MISC_FEATURE (211)..(230): This region may encompass 1-20 Gly residues
  MOD_RES (231)..(231): Ser, Asp, Glu, Thr or Pro
  MISC_FEATURE (232)..(251): This region may encompass 1-20 Gly residues
  MOD_RES (252)..(252): Ser, Asp, Glu, Thr or Pro
  MISC_FEATURE (253)..(272): This region may encompass 1-20 Gly residues
  MOD_RES (273)..(273): Ser, Asp, Glu, Thr or Pro
  MISC_FEATURE (274)..(293): This region may encompass 1-20 Gly residues
  MOD_RES (294)..(294): Ser, Asp, Glu, Thr or Pro
  MISC_FEATURE (295)..(314): This region may encompass 1-20 Gly residues
  MOD_RES (315)..(315): Ser, Asp, Glu, Thr or Pro
GGGGGGGGGGGGGGGGGGGGXGGGGGGGGGGGGGGGGGGGGXGGGGGGGGGGGGGGGGGGGGXGGGGGGGGGGGGGGGGGGGGXGGGGGGGGGGGGGGGGGGGGXGGGGGGGGGGGGGGGGGGGGXGGGGGGGGGGGGGGGGGGGGXGGGGGGGGGGGGGGGGGGGGXGGGGGGGGGGGGGGGGGGGGXGGGGGGGGGGGGGGGGGGGGXGGGGGGGGGGGGGGGGGGGGXGGGGGGGGGGGGGGGGGGGGXGGGGGGGGGGGGGGGGGGGGXGGGGGGGGGGGGGGGGGGGGXGGGGGGGGGGGGGGGGGGGGX

SEQ ID NO: 13 - protein, 11 aa, Artificial Sequence
  Description of Artificial Sequence: Synthetic peptide
RASQSIRNYLN

SEQ ID NO: 14 - protein, 7 aa, Artificial Sequence
  Description of Artificial Sequence: Synthetic peptide
AASTLQS

SEQ ID NO: 15 - protein, 9 aa, Artificial Sequence
  Description of Artificial Sequence: Synthetic peptide
QQLSGYPHT

SEQ ID NO: 16 - protein, 5 aa, Artificial Sequence
  Description of Artificial Sequence: Synthetic peptide
FYYMV

SEQ ID NO: 17 - protein, 17 aa, Artificial Sequence
  Description of Artificial Sequence: Synthetic peptide
VIYPSGGITVYADSVKG

SEQ ID NO: 18 - protein, 16 aa, Artificial Sequence
  Description of Artificial Sequence: Synthetic peptide
DKWAVMPPYYYYAMDV

SEQ ID NO: 19 - protein, 14 aa, Artificial Sequence
  Description of Artificial Sequence: Synthetic peptide
TGTNSDVGNYNLVS

SEQ ID NO: 20 - protein, 7 aa, Artificial Sequence
  Description of Artificial Sequence: Synthetic peptide
EVNKRPS

SEQ ID NO: 21 - protein, 11 aa, Artificial Sequence
  Description of Artificial Sequence: Synthetic peptide
CSYAGNRNFYV

SEQ ID NO: 22 - protein, 5 aa, Artificial Sequence
  Description of Artificial Sequence: Synthetic peptide
WYSMV

SEQ ID NO: 23 - protein, 17 aa, Artificial Sequence
  Description of Artificial Sequence: Synthetic peptide
SISPSGGLTNYADSVKG

SEQ ID NO: 24 - protein, 14 aa, Artificial Sequence
  Description of Artificial Sequence: Synthetic peptide
HTAARPFYYYYMDV

SEQ ID NO: 25 - protein, 11 aa, Artificial Sequence
  Description of Artificial Sequence: Synthetic peptide
SGDKLGDKYAC

SEQ ID NO: 26 - protein, 7 aa, Artificial Sequence
  Description of Artificial Sequence: Synthetic peptide
QDSKRPS

SEQ ID NO: 27 - protein, 9 aa, Artificial Sequence
  Description of Artificial Sequence: Synthetic peptide
QAWDSSTGV

SEQ ID NO: 28 - protein, 5 aa, Artificial Sequence
  Description of Artificial Sequence: Synthetic peptide
WYLMI

SEQ ID NO: 29 - protein, 17 aa, Artificial Sequence
  Description of Artificial Sequence: Synthetic peptide
YIYPSGGFTYYADSVKG

SEQ ID NO: 30 - protein, 13 aa, Artificial Sequence
  Description of Artificial Sequence: Synthetic peptide
TEGPLSWGYGMDV

SEQ ID NO: 31 - protein, 11 aa, Artificial Sequence
  Description of Artificial Sequence: Synthetic peptide
SGDKLGNKYAY

SEQ ID NO: 32 - protein, 7 aa, Artificial Sequence
  Description of Artificial Sequence: Synthetic peptide
QDNNRPS

SEQ ID NO: 33 - protein, 9 aa, Artificial Sequence
  Description of Artificial Sequence: Synthetic peptide
QAWDSRTVV

SEQ ID NO: 34 - protein, 5 aa, Artificial Sequence
  Description of Artificial Sequence: Synthetic peptide
TYFML

SEQ ID NO: 35 - protein, 17 aa, Artificial Sequence
  Description of Artificial Sequence: Synthetic peptide
SIYPSGGNTVYADSVKG

SEQ ID NO: 36 - protein, 15 aa, Artificial Sequence
  Description of Artificial Sequence: Synthetic peptide
AASPVRNYYYYGMDV

SEQ ID NO: 37 - protein, 11 aa, Artificial Sequence
  Description of Artificial Sequence: Synthetic peptide
RASQSISVYLN

SEQ ID NO: 38 - protein, 7 aa, Artificial Sequence
  Description of Artificial Sequence: Synthetic peptide
GASNLQF

SEQ ID NO: 39 - protein, 8 aa, Artificial Sequence
  Description of Artificial Sequence: Synthetic peptide
QQTFSLFT

SEQ ID NO: 40 - protein, 5 aa, Artificial Sequence
  Description of Artificial Sequence: Synthetic peptide
FYNMN

SEQ ID NO: 41 - protein, 17 aa, Artificial Sequence
  Description of Artificial Sequence: Synthetic peptide
SISPSGGETNYADSVKG

SEQ ID NO: 42 - protein, 15 aa, Artificial Sequence
  Description of Artificial Sequence: Synthetic peptide
GGGAYRNNWWGGFDI

SEQ ID NO: 43 - protein, 12 aa, Artificial Sequence
  Description of Artificial Sequence: Synthetic peptide
RASQSVSSSYLA

SEQ ID NO: 44 - protein, 7 aa, Artificial Sequence
  Description of Artificial Sequence: Synthetic peptide
GASSRAT

SEQ ID NO: 45 - protein, 9 aa, Artificial Sequence
  Description of Artificial Sequence: Synthetic peptide
QQYGSSPFT

SEQ ID NO: 46 - protein, 5 aa, Artificial Sequence
  Description of Artificial Sequence: Synthetic peptide
PYNMY

SEQ ID NO: 47 - protein, 17 aa, Artificial Sequence
  Description of Artificial Sequence: Synthetic peptide
SIRPSGGGTVYADSVKG

SEQ ID NO: 48 - protein, 12 aa, Artificial Sequence
  Description of Artificial Sequence: Synthetic peptide
GFIAARWYYFDY

SEQ ID NO: 49 - protein, 11 aa, Artificial Sequence
  Description of Artificial Sequence: Synthetic peptide
SGDQLGDKYVG

SEQ ID NO: 50 - protein, 7 aa, Artificial Sequence
  Description of Artificial Sequence: Synthetic peptide
QDTKRPS

SEQ ID NO: 51 - protein, 9 aa, Artificial Sequence
  Description of Artificial Sequence: Synthetic peptide
QAWDTSTAG

SEQ ID NO: 52 - protein, 5 aa, Artificial Sequence
  Description of Artificial Sequence: Synthetic peptide
WYTMV

SEQ ID NO: 53 - protein, 17 aa, Artificial Sequence
  Description of Artificial Sequence: Synthetic peptide
RIYPSGGWTKYADSVKG

SEQ ID NO: 54 - protein, 13 aa, Artificial Sequence
  Description of Artificial Sequence: Synthetic peptide
EGLLWFGENAFDI

SEQ ID NO: 55 - protein, 11 aa, Artificial Sequence
  Description of Artificial Sequence: Synthetic peptide
SGDKLGDKYAC

SEQ ID NO: 56 - protein, 7 aa, Artificial Sequence
  Description of Artificial Sequence: Synthetic peptide
QDSKRPS

SEQ ID NO: 57 - protein, 9 aa, Artificial Sequence
  Description of Artificial Sequence: Synthetic peptide
QAWDSSTGV

SEQ ID NO: 58 - protein, 5 aa, Artificial Sequence
  Description of Artificial Sequence: Synthetic peptide
WYLMI

SEQ ID NO: 59 - protein, 17 aa, Artificial Sequence
  Description of Artificial Sequence: Synthetic peptide
YIYPSGGFTYYADSVKG

SEQ ID NO: 60 - protein, 13 aa, Artificial Sequence
  Description of Artificial Sequence: Synthetic peptide
TEGPLSWGYGMDV

SEQ ID NO: 61 - protein, 11 aa, Artificial Sequence
  Description of Artificial Sequence: Synthetic peptide
SGDQLGDKYVG

SEQ ID NO: 62 - protein, 7 aa, Artificial Sequence
  Description of Artificial Sequence: Synthetic peptide
QDTKRPS

SEQ ID NO: 63 - protein, 9 aa, Artificial Sequence
  Description of Artificial Sequence: Synthetic peptide
QAWDTSTAG

SEQ ID NO: 64 - protein, 5 aa, Artificial Sequence
  Description of Artificial Sequence: Synthetic peptide
WYTMV

SEQ ID NO: 65 - protein, 17 aa, Artificial Sequence
  Description of Artificial Sequence: Synthetic peptide
RIYPSGGWTKYADSVKG

SEQ ID NO: 66 - protein, 13 aa, Artificial Sequence
  Description of Artificial Sequence: Synthetic peptide
EGLLWFGENAFDI

SEQ ID NO: 67 - protein, 11 aa, Artificial Sequence
  Description of Artificial Sequence: Synthetic peptide
SGNKLGDKYVA

SEQ ID NO: 68 - protein, 7 aa, Artificial Sequence
  Description of Artificial Sequence: Synthetic peptide
QDTKRPS

SEQ ID NO: 69 - protein, 9 aa, Artificial Sequence
  Description of Artificial Sequence: Synthetic peptide
QAWDSSIVI

SEQ ID NO: 70 - protein, 5 aa, Artificial Sequence
  Description of Artificial Sequence: Synthetic peptide
WYTMV

SEQ ID NO: 71 - protein, 17 aa, Artificial Sequence
  Description of Artificial Sequence: Synthetic peptide
YIYPSGGATFYADSVKG

SEQ ID NO: 72 - protein, 13 aa, Artificial Sequence
  Description of Artificial Sequence: Synthetic peptide
GSYDYIWGFYSDH

SEQ ID NO: 73 - protein, 11 aa, Artificial Sequence
  Description of Artificial Sequence: Synthetic peptide
SGDNLGNKYNS

SEQ ID NO: 74 - protein, 7 aa, Artificial Sequence
  Description of Artificial Sequence: Synthetic peptide
QDTKRPS

SEQ ID NO: 75 - protein, 8 aa, Artificial Sequence
  Description of Artificial Sequence: Synthetic peptide
QAWDGNVV

SEQ ID NO: 76 - protein, 5 aa, Artificial Sequence
  Description of Artificial Sequence: Synthetic peptide
WYEMG

SEQ ID NO: 77 - protein, 17 aa, Artificial Sequence
  Description of Artificial Sequence: Synthetic peptide
SIYSSGGGTMYADSVKG

SEQ ID NO: 78 - protein, 18 aa, Artificial Sequence
  Description of Artificial Sequence: Synthetic peptide
NPQYSGYDRSLSDGAFDI

SEQ ID NO: 79 - protein, 11 aa, Artificial Sequence
  Description of Artificial Sequence: Synthetic peptide
RASQSVSSYLA

SEQ ID NO: 80 - protein, 7 aa, Artificial Sequence
  Description of Artificial Sequence: Synthetic peptide
DASNRAT

SEQ ID NO: 81 - protein, 11 aa, Artificial Sequence
  Description of Artificial Sequence: Synthetic peptide
QQRSNWPRGFT

SEQ ID NO: 82 - protein, 5 aa, Artificial Sequence
  Description of Artificial Sequence: Synthetic peptide
YYHMS

SEQ ID NO: 83 - protein, 17 aa, Artificial Sequence
  Description of Artificial Sequence: Synthetic peptide
VISPSGGSTKYADSVKG

SEQ ID NO: 84 - protein, 19 aa, Artificial Sequence
  Description of Artificial Sequence: Synthetic peptide
GGSSDYAWGSYRRPYYFDY

SEQ ID NO: 85 - protein, 11 aa, Artificial Sequence
  Description of Artificial Sequence: Synthetic peptide
SGEKLGDKYVS

SEQ ID NO: 86 - protein, 7 aa, Artificial Sequence
  Description of Artificial Sequence: Synthetic peptide
EDSRRPS

SEQ ID NO: 87 - protein, 9 aa, Artificial Sequence
  Description of Artificial Sequence: Synthetic peptide
QAWDSSTAI

SEQ ID NO: 88 - protein, 5 aa, Artificial Sequence
  Description of Artificial Sequence: Synthetic peptide
YYMMV

SEQ ID NO: 89 - protein, 17 aa, Artificial Sequence
  Description of Artificial Sequence: Synthetic peptide
YIYSSGGHTVYADSVKG

SEQ ID NO: 90 - protein, 15 aa, Artificial Sequence
  Description of Artificial Sequence: Synthetic peptide
DLFLYDFWSKGAFDI

SEQ ID NO: 91 - protein, 11 aa, Artificial Sequence
  Description of Artificial Sequence: Synthetic peptide
SGDKLGDKYTS

SEQ ID NO: 92 - protein, 7 aa, Artificial Sequence
  Description of Artificial Sequence: Synthetic peptide
QDIKRPS

SEQ ID NO: 93 - protein, 10 aa, Artificial Sequence
  Description of Artificial Sequence: Synthetic peptide
QAWDSPNARV

SEQ ID NO: 94 - protein, 5 aa, Artificial Sequence
  Description of Artificial Sequence: Synthetic peptide
HYRMS

SEQ ID NO: 95 - protein, 17 aa, Artificial Sequence
  Description of Artificial Sequence: Synthetic peptide
SIYPSGGRTVYADSVKG

SEQ ID NO: 96 - protein, 19 aa, Artificial Sequence
  Description of Artificial Sequence: Synthetic peptide
DKFEWRLLFRGIGNDAFDI

SEQ ID NO: 97 - protein, 13 aa, Artificial Sequence
  Description of Artificial Sequence: Synthetic peptide
SGSSSNIGSNTVS

SEQ ID NO: 98 - protein, 7 aa, Artificial Sequence
  Description of Artificial Sequence: Synthetic peptide
NDHRRPS

SEQ ID NO: 99 - protein, 11 aa, Artificial Sequence
  Description of Artificial Sequence: Synthetic peptide
SAWDDSLNGVV

SEQ ID NO: 100 - protein, 5 aa, Artificial Sequence
  Description of Artificial Sequence: Synthetic peptide
RYEMY

SEQ ID NO: 101 - protein, 17 aa, Artificial Sequence
  Description of Artificial Sequence: Synthetic peptide
SISSSGGPTAYADSVKG

SEQ ID NO: 102 - protein, 20 aa, Artificial Sequence
  Description of Artificial Sequence: Synthetic peptide
GTPKWELLLRSIYIENAFDI

SEQ ID NO: 103 - protein, 15 aa, Artificial Sequence
  Description of Artificial Sequence: Synthetic peptide
RSSQSLSDDGNTYLD

SEQ ID NO: 104 - protein, 7 aa, Artificial Sequence
  Description of Artificial Sequence: Synthetic peptide
TLSYRAS

SEQ ID NO: 105 - protein, 9 aa, Artificial Sequence
  Description of Artificial Sequence: Synthetic peptide
MQGTHWPPT

SEQ ID NO: 106 - protein, 5 aa, Artificial Sequence
  Description of Artificial Sequence: Synthetic peptide
FYAMH

SEQ ID NO: 107 - protein, 17 aa, Artificial Sequence
  Description of Artificial Sequence: Synthetic peptide
GIVPSGGRTHYADSVKG

SEQ ID NO: 108 - protein, 12 aa, Artificial Sequence
  Description of Artificial Sequence: Synthetic peptide
DSSGSPNPLFDY

SEQ ID NO: 109 - protein, 16 aa, Artificial Sequence
  Description of Artificial Sequence: Synthetic peptide
RSSLSLLHSNGYNYLD

SEQ ID NO: 110 - protein, 7 aa, Artificial Sequence
  Description of Artificial Sequence: Synthetic peptide
LSSTRAS

SEQ ID NO: 111 - protein, 9 aa, Artificial Sequence
  Description of Artificial Sequence: Synthetic peptide
MQPLETPPT

SEQ ID NO: 112 - protein, 5 aa, Artificial Sequence
  Description of Artificial Sequence: Synthetic peptide
YYEMD

SEQ ID NO: 113 - protein, 17 aa, Artificial Sequence
  Description of Artificial Sequence: Synthetic peptide
GISSSGGHTAYADSVKG

SEQ ID NO: 114 - protein, 16 aa, Artificial Sequence
  Description of Artificial Sequence: Synthetic peptide
ERRSSSRARYYYGMDV

SEQ ID NO: 115 - protein, 13 aa, Artificial Sequence
  Description of Artificial Sequence: Synthetic peptide
SGNNSNFGSNTVT

SEQ ID NO: 116 - protein, 7 aa, Artificial Sequence
  Description of Artificial Sequence: Synthetic peptide
SDSRRPS

SEQ ID NO: 117 - protein, 10 aa, Artificial Sequence
  Description of Artificial Sequence: Synthetic peptide
AAWDDSLNGV

SEQ ID NO: 118 - protein, 5 aa, Artificial Sequence
  Description of Artificial Sequence: Synthetic peptide
DYRMQ

SEQ ID NO: 119 - protein, 17 aa, Artificial Sequence
  Description of Artificial Sequence: Synthetic peptide
VIVPSGGNTMYADSVKG

SEQ ID NO: 120 - protein, 21 aa, Artificial Sequence
  Description of Artificial Sequence: Synthetic peptide
GGPGSSIAARRAPTGYYGMDV

SEQ ID NO: 121 - protein, 11 aa, Artificial Sequence
  Description of Artificial Sequence: Synthetic peptide
RASQPIDNYLN

SEQ ID NO: 122 - protein, 7 aa, Artificial Sequence
  Description of Artificial Sequence: Synthetic peptide
AASRLQS

SEQ ID NO: 123 - protein, 9 aa, Artificial Sequence
  Description of Artificial Sequence: Synthetic peptide
QQSYTVPYT

SEQ ID NO: 124 - protein, 5 aa, Artificial Sequence
  Description of Artificial Sequence: Synthetic peptide
AYSMI

SEQ ID NO: 125 - protein, 17 aa, Artificial Sequence
  Description of Artificial Sequence: Synthetic peptide
YIRPSGGRTTYADSVKG

SEQ ID NO: 126 - protein, 17 aa, Artificial Sequence
  Description of Artificial Sequence: Synthetic peptide
GGLLLWFRELKSNYFDY

SEQ ID NO: 127 - protein, 11 aa, Artificial Sequence
  Description of Artificial Sequence: Synthetic peptide
RASQSVSSYLA

SEQ ID NO: 128 - protein, 7 aa, Artificial Sequence
  Description of Artificial Sequence: Synthetic peptide
DASNRAT

SEQ ID NO: 129 - protein, 11 aa, Artificial Sequence
  Description of Artificial Sequence: Synthetic peptide
QQRSNWPRGFT

SEQ ID NO: 130 - protein, 5 aa, Artificial Sequence
  Description of Artificial Sequence: Synthetic peptide
YYHMS

SEQ ID NO: 131 - protein, 17 aa, Artificial Sequence
  Description of Artificial Sequence: Synthetic peptide
VISPSGGSTKYADSVKG

SEQ ID NO: 132 - protein, 19 aa, Artificial Sequence
  Description of Artificial Sequence: Synthetic peptide
GGSSDYAWGSYRRPYYFDY

SEQ ID NO: 133 - protein, 11 aa, Artificial Sequence
  Description of Artificial Sequence: Synthetic peptide
SGDKLGDKYTS

SEQ ID NO: 134 - protein, 7 aa, Artificial Sequence
  Description of Artificial Sequence: Synthetic peptide
QDIKRPS

SEQ ID NO: 135 - protein, 10 aa, Artificial Sequence
  Description of Artificial Sequence: Synthetic peptide
QAWDSPNARV

SEQ ID NO: 136 - protein, 5 aa, Artificial Sequence
  Description of Artificial Sequence: Synthetic peptide
HYRMS

SEQ ID NO: 137 - protein, 17 aa, Artificial Sequence
  Description of Artificial Sequence: Synthetic peptide
SIYPSGGRTVYADSVKG

SEQ ID NO: 138 - protein, 19 aa, Artificial Sequence
  Description of Artificial Sequence: Synthetic peptide
DKFEWRLLFRGIGNDAFDI

SEQ ID NO: 139 - protein, 11 aa, Artificial Sequence
  Description of Artificial Sequence: Synthetic peptide
RASGDIGNALG

SEQ ID NO: 140 - protein, 7 aa, Artificial Sequence
  Description of Artificial Sequence: Synthetic peptide
DASTLQS

SEQ ID NO: 141 - protein, 9 aa, Artificial Sequence
  Description of Artificial Sequence: Synthetic peptide
LQGYNYPRT

SEQ ID NO: 142 - protein, 5 aa, Artificial Sequence
  Description of Artificial Sequence: Synthetic peptide
RYIMH

SEQ ID NO: 143 - protein, 17 aa, Artificial Sequence
  Description of Artificial Sequence: Synthetic peptide
SISPSGGLTSYADSVKG

SEQ ID NO: 144 - protein, 15 aa, Artificial Sequence
  Description of Artificial Sequence: Synthetic peptide
EFENAYHYYYYGMDV

SEQ ID NO: 145 - protein, 11 aa, Artificial Sequence
  Description of Artificial Sequence: Synthetic peptide
RASQSISSYLS

SEQ ID NO: 146 - protein, 7 aa, Artificial Sequence
  Description of Artificial Sequence: Synthetic peptide
AASSLQS

SEQ ID NO: 147 - protein, 9 aa, Artificial Sequence
  Description of Artificial Sequence: Synthetic peptide
QQSISIPRT

SEQ ID NO: 148 - protein, 5 aa, Artificial Sequence
  Description of Artificial Sequence: Synthetic peptide
PYFMG

SEQ ID NO: 149 - protein, 17 aa, Artificial Sequence
  Description of Artificial Sequence: Synthetic peptide
GIGPSGGSTTYADSVKG

SEQ ID NO: 150 - protein, 20 aa, Artificial Sequence
  Description of Artificial Sequence: Synthetic peptide
EGPPYSSGWYRGLRQYHFDY

SEQ ID NO: 151 - protein, 11 aa, Artificial Sequence
  Description of Artificial Sequence: Synthetic peptide
RASQGISSYLA

SEQ ID NO: 152 - protein, 7 aa, Artificial Sequence
  Description of Artificial Sequence: Synthetic peptide
AASTLQS

SEQ ID NO: 153 - protein, 9 aa, Artificial Sequence
  Description of Artificial Sequence: Synthetic peptide
QQLNSYPLT

SEQ ID NO: 154 - protein, 5 aa, Artificial Sequence
  Description of Artificial Sequence: Synthetic peptide
HYLMT

SEQ ID NO: 155 - protein, 17 aa, Artificial Sequence
  Description of Artificial Sequence: Synthetic peptide
YISPSGGHTIYADSVKG

SEQ ID NO: 156 - protein, 16 aa, Artificial Sequence
  Description of Artificial Sequence: Synthetic peptide
VARGIAARSRTSYFDY

SEQ ID NO: 157 - protein, 11 aa, Artificial Sequence
  Description of Artificial Sequence: Synthetic peptide
SGDKLGDKYVS

SEQ ID NO: 158 - protein, 7 aa, Artificial Sequence
  Description of Artificial Sequence: Synthetic peptide
QDTKRPS

SEQ ID NO: 159 - protein, 9 aa, Artificial Sequence
  Description of Artificial Sequence: Synthetic peptide
QAWDSSTYV

SEQ ID NO: 160 - protein, 5 aa, Artificial Sequence
  Description of Artificial Sequence: Synthetic peptide
DYAMK

SEQ ID NO: 161 - protein, 17 aa, Artificial Sequence
  Description of Artificial Sequence: Synthetic peptide
SISSSGGVTQYADSVKG

SEQ ID NO: 162 - protein, 21 aa, Artificial Sequence
  Description of Artificial Sequence: Synthetic peptide
EEDYSSSWYSRRFDYYYGMDV

SEQ ID NO: 163 - protein, 11 aa, Artificial Sequence
  Description of Artificial Sequence: Synthetic peptide
RASQSISSWLA

SEQ ID NO: 164 - protein, 7 aa, Artificial Sequence
  Description of Artificial Sequence: Synthetic peptide
KASTLES

SEQ ID NO: 165 - protein, 8 aa, Artificial Sequence
  Description of Artificial Sequence: Synthetic peptide
QQYNTYWT

SEQ ID NO: 166 - protein, 5 aa, Artificial Sequence
  Description of Artificial Sequence: Synthetic peptide
HYIMM

SEQ ID NO: 167 - protein, 17 aa, Artificial Sequence
  Description of Artificial Sequence: Synthetic peptide
GIYSSGGITVYADSVKG

SEQ ID NO: 168 - protein, 13 aa, Artificial Sequence
  Description of Artificial Sequence: Synthetic peptide
RRTGIPRRDAFDI

SEQ ID NO: 169 - protein, 11 aa, Artificial Sequence
  Description of Artificial Sequence: Synthetic peptide
RASQPIDNYLN

SEQ ID NO: 170 - protein, 7 aa, Artificial Sequence
  Description of Artificial Sequence: Synthetic peptide
AASRLQS

SEQ ID NO: 171 - protein, 9 aa, Artificial Sequence
  Description of Artificial Sequence: Synthetic peptide
QQSYTVPYT

SEQ ID NO: 172 - protein, 5 aa, Artificial Sequence
  Description of Artificial Sequence: Synthetic peptide
AYSMI

SEQ ID NO: 173 - protein, 17 aa, Artificial Sequence
  Description of Artificial Sequence: Synthetic peptide
YIRPSGGRTTYADSVKG

SEQ ID NO: 174 - protein, 17 aa, Artificial Sequence
  Description of Artificial Sequence: Synthetic peptide
GGLLLWSRELKSNYFDY

SEQ ID NO: 175 - protein, 11 aa, Artificial Sequence
  Description of Artificial Sequence: Synthetic peptide
RASQPIDNYLN

SEQ ID NO: 176 - protein, 7 aa, Artificial Sequence
  Description of Artificial Sequence: Synthetic peptide
AASRLQS

SEQ ID NO: 177 - protein, 9 aa, Artificial Sequence
  Description of Artificial Sequence: Synthetic peptide
QQSYTVPYT

SEQ ID NO: 178 - protein, 5 aa, Artificial Sequence
  Description of Artificial Sequence: Synthetic peptide
AYSMI

SEQ ID NO: 179 - protein, 17 aa, Artificial Sequence
  Description of Artificial Sequence: Synthetic peptide
YIRPSGGRTTYADSVKG

SEQ ID NO: 180 - protein, 17 aa, Artificial Sequence
  Description of Artificial Sequence: Synthetic peptide
GGLLLWFMELKSNYFDY

SEQ ID NO: 181 - protein, 11 aa, Artificial Sequence
  Description of Artificial Sequence: Synthetic peptide
RASQPIDNYLN

SEQ ID NO: 182 - protein, 7 aa, Artificial Sequence
  Description of Artificial Sequence: Synthetic peptide
AASRLQS

SEQ ID NO: 183 - protein, 9 aa, Artificial Sequence
  Description of Artificial Sequence: Synthetic peptide
QQSYTVPYT

SEQ ID NO: 184 - protein, 5 aa, Artificial Sequence
  Description of Artificial Sequence: Synthetic peptide
AYSMI

SEQ ID NO: 185 - protein, 17 aa, Artificial Sequence
  Description of Artificial Sequence: Synthetic peptide
YIRPSGGRTTYADSVKG

SEQ ID NO: 186 - protein, 17 aa, Artificial Sequence
  Description of Artificial Sequence: Synthetic peptide
GGLLLWGRELKSNYFDY

SEQ ID NO: 187 - protein, 11 aa, Artificial Sequence
  Description of Artificial Sequence: Synthetic peptide
RASQPIDNYLN

SEQ ID NO: 188 - protein, 7 aa, Artificial Sequence
  Description of Artificial Sequence: Synthetic peptide
AASRLQS

SEQ ID NO: 189 - protein, 9 aa, Artificial Sequence
  Description of Artificial Sequence: Synthetic peptide
QQSYTVPYT

SEQ ID NO: 190 - protein, 5 aa, Artificial Sequence
  Description of Artificial Sequence: Synthetic peptide
AYSMI

SEQ ID NO: 191 - protein, 17 aa, Artificial Sequence
  Description of Artificial Sequence: Synthetic peptide
YIRPSGGRTTYADSVKG

SEQ ID NO: 192 - protein, 17 aa, Artificial Sequence
  Description of Artificial Sequence: Synthetic peptide
GGLLLWNRELKSNYFDY

SEQ ID NO: 193 - protein, 11 aa, Artificial Sequence
  Description of Artificial Sequence: Synthetic peptide
RASQPIDNYLN

SEQ ID NO: 194 - protein, 7 aa, Artificial Sequence
  Description of Artificial Sequence: Synthetic peptide
AASRLQS

SEQ ID NO: 195 - protein, 9 aa, Artificial Sequence
  Description of Artificial Sequence: Synthetic peptide
QQSYTVPYT

SEQ ID NO: 196 - protein, 5 aa, Artificial Sequence
  Description of Artificial Sequence: Synthetic peptide
AYSMI

SEQ ID NO: 197 - protein, 17 aa, Artificial Sequence
  Description of Artificial Sequence: Synthetic peptide
YIRPSGGRTTYADSVKG

SEQ ID NO: 198 - protein, 17 aa, Artificial Sequence
  Description of Artificial Sequence: Synthetic peptide
GGLLLWDRELKSNYFDY

SEQ ID NO: 199 - protein, 11 aa, Artificial Sequence
  Description of Artificial Sequence: Synthetic peptide
RASQPIDNYLN

SEQ ID NO: 200 - protein, 7 aa, Artificial Sequence
  Description of Artificial Sequence: Synthetic peptide
AASRLQS

SEQ ID NO: 201 - protein, 9 aa, Artificial Sequence
  Description of Artificial Sequence: Synthetic peptide
QQSYTVPYT

SEQ ID NO: 202 - protein, 5 aa, Artificial Sequence
  Description of Artificial Sequence: Synthetic peptide
AYSMI

SEQ ID NO: 203 - protein, 17 aa, Artificial Sequence
  Description of Artificial Sequence: Synthetic peptide
YIRPSGGRTTYADSVKG

SEQ ID NO: 204 - protein, 17 aa, Artificial Sequence
  Description of Artificial Sequence: Synthetic peptide
GGLLLWQRELKSNYFDY

SEQ ID NO: 205 - protein, 11 aa, Artificial Sequence
  Description of Artificial Sequence: Synthetic peptide
RASQPIDNYLN

SEQ ID NO: 206 - protein, 7 aa, Artificial Sequence
  Description of Artificial Sequence: Synthetic peptide
AASRLQS

SEQ ID NO: 207 - protein, 9 aa, Artificial Sequence
  Description of Artificial Sequence: Synthetic peptide
QQSYTVPYT

SEQ ID NO: 208 - protein, 5 aa, Artificial Sequence
  Description of Artificial Sequence: Synthetic peptide
AYSMI

SEQ ID NO: 209 - protein, 17 aa, Artificial Sequence
  Description of Artificial Sequence: Synthetic peptide
YIRPSGGRTTYADSVKG

SEQ ID NO: 210 - protein, 17 aa, Artificial Sequence
  Description of Artificial Sequence: Synthetic peptide
GGLLLWTRELKSNYFDY

SEQ ID NO: 211 - protein, 11 aa, Artificial Sequence
  Description of Artificial Sequence: Synthetic peptide
RASQPIDNYLN

SEQ ID NO: 212 - protein, 7 aa, Artificial Sequence
  Description of Artificial Sequence: Synthetic peptide
AASRLQS

SEQ ID NO: 213 - protein, 9 aa, Artificial Sequence
  Description of Artificial Sequence: Synthetic peptide
QQSYTVPYT

SEQ ID NO: 214 - protein, 5 aa, Artificial Sequence
  Description of Artificial Sequence: Synthetic peptide
AYSMI

SEQ ID NO: 215 - protein, 17 aa, Artificial Sequence
  Description of Artificial Sequence: Synthetic peptide
YIRPSGGRTTYADSVKG

SEQ ID NO: 216 - protein, 17 aa, Artificial Sequence
  Description of Artificial Sequence: Synthetic peptide
GGLLLWARELKSNYFDY

SEQ ID NO: 217 - protein, 11 aa, Artificial Sequence
  Description of Artificial Sequence: Synthetic peptide
RASQPIDNYLN

SEQ ID NO: 218 - protein, 7 aa, Artificial Sequence
  Description of Artificial Sequence: Synthetic peptide
AASRLQS

SEQ ID NO: 219 - protein, 9 aa, Artificial Sequence
  Description of Artificial Sequence: Synthetic peptide
QQSYTVPYT

SEQ ID NO: 220 - protein, 5 aa, Artificial Sequence
  Description of Artificial Sequence: Synthetic peptide
AYSMI

SEQ ID NO: 221 - protein, 17 aa, Artificial Sequence
  Description of Artificial Sequence: Synthetic peptide
YIRPSGGRTTYADSVKG

SEQ ID NO: 222 - protein, 17 aa, Artificial Sequence
  Description of Artificial Sequence: Synthetic peptide
GGLLLWERELKSNYFDY

SEQ ID NO: 223 - protein, 12 aa, Artificial Sequence
  Description of Artificial Sequence: Synthetic peptide
RTSQFVNSNYLA

SEQ ID NO: 224 - protein, 7 aa, Artificial Sequence
  Description of Artificial Sequence: Synthetic peptide
GASSRAT

SEQ ID NO: 225 - protein, 9 aa, Artificial Sequence
  Description of Artificial Sequence: Synthetic peptide
QQSSRTPWT

SEQ ID NO: 226 - protein, 5 aa, Artificial Sequence
  Description of Artificial Sequence: Synthetic peptide
HYLMT

SEQ ID NO: 227 - protein, 17 aa, Artificial Sequence
  Description of Artificial Sequence: Synthetic peptide
YISPSGGHTIYADSVKG

SEQ ID NO: 228 - protein, 16 aa, Artificial Sequence
  Description of Artificial Sequence: Synthetic peptide
VARGIAARSRTSYFDY

SEQ ID NO: 229 - protein, 108 aa, Artificial Sequence
  Description of Artificial Sequence: Synthetic polypeptide
QDIQMTQSPSSLSASVGDRVTITCRASQSIRNYLNWYQQKPGKAPNLLIYAASTLQSGVPARFSGSGSGTDFTLTISSLQPEDFATYYCQQLSGYPHTFGQGTKLEIK

SEQ ID NO: 230 - protein, 142 aa, Artificial Sequence
  Description of Artificial Sequence: Synthetic polypeptide
EVQLLESGGGLVQPGGSLRLSCAASGFTFSFYYMVWVRQAPGKGLEWVSVIYPSGGITVYADSVKGRFTISRDNSKNTLYLQMNSLRAEDTAVYYCARDKWAVMPPYYYYAMDVWGQGTTVTVSSASTKGPSVFPLAPSSKS

SEQ ID NO: 231 - protein, 111 aa, Artificial Sequence
  Description of Artificial Sequence: Synthetic polypeptide
QSALTQPASVSGSPGQSITISCTGTNSDVGNYNLVSWYQQHPGEAPKLLIYEVNKRPSGVSNRFSGSKSGNTASLTISGLQAEDEADYLCCSYAGNRNFYVFGAGTKVTVL

SEQ ID NO: 232 - protein, 140 aa, Artificial Sequence
  Description of Artificial Sequence: Synthetic polypeptide
EVQLLESGGGLVQPGGSLRLSCAASGFTFSWYSMVWVRQAPGKGLEWVSSISPSGGLTNYADSVKGRFTISRDNSKNTLYLQMNSLRAEDTAVYYCARHTAARPFYYYYMDVWGKGTTVTVSSASTKGPSVFPLAPSSKS

SEQ ID NO: 233 - protein, 106 aa, Artificial Sequence
  Description of Artificial Sequence: Synthetic polypeptide
QSELTQPPSVSVSPGQTASITCSGDKLGDKYACWYQQKPGQSPVLVIYQDSKRPSGIPERFSGSNSGNTATLTISGTQAMDEADYYCQAWDSSTGVFGGGTKLTVL

SEQ ID NO: 234 - protein, 139 aa, Artificial Sequence
  Description of Artificial Sequence: Synthetic polypeptide
EVQLLESGGGLVQPGGSLRLSCAASGFTFSWYLMIWVRQAPGKGLEWVSYIYPSGGFTYYADSVKGRFTISRDNSKNTLYLQMNSLRAEDMAVYYCARTEGPLSWGYGMDVWGQGTTVTVSSASTKGPSVFPLAPSSKS

SEQ ID NO: 235 - protein, 106 aa, Artificial Sequence
  Description of Artificial Sequence: Synthetic polypeptide
QCELTQPPSESVSPGQTANITCSGDKLGNKYAYWYQQKPGQSPVLVIYQDNNRPSGIPERFSGSNSGNTATLTISGTQAIDEANYYCQAWDSRTVVFGGGTKLTVL

SEQ ID NO: 236 - protein, 141 aa, Artificial Sequence
  Description of Artificial Sequence: Synthetic polypeptide
EVQLLESGGGLVQPGGSLRLSCAASGFTFSTYFMLWVRQAPGKGLEWVSSIYPSGGNTVYADSVKGRFTISRDNSKNTLYLQMNSLRAEDTAVYYCARAASPVRNYYYYGMDVWGQGTTVTVSSASTKGPSVFPLAPSSKS

SEQ ID NO: 237 - protein, 107 aa, Artificial Sequence
  Description of Artificial Sequence: Synthetic polypeptide
QDIQMTQSPSSLSASVGDRVTITCRASQSISVYLNWYQHKPGKAPKLLIYGASNLQFGVPSRFSGSGYGTDFTLTISSLQPEDFATYHCQQTFSLFTFGGGTKVEIK

SEQ ID NO: 238 - protein, 141 aa, Artificial Sequence
  Description of Artificial Sequence: Synthetic polypeptide
EVQLLESGGGLVQPGGSLRLSCAASGFTFSFYNMNWVRQAPGKGLEWVSSISPSGGETNYADSVKGRFTISRDNSKNTLYLQMNSLRAEDTAVYYCARGGGAYRNNWWGGFDIWGLGTMVTVSSASTKGPSVFPLAPSSKS

SEQ ID NO: 239 - protein, 109 aa, Artificial Sequence
  Description of Artificial Sequence: Synthetic polypeptide
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK

SEQ ID NO: 240 - protein, 138 aa, Artificial Sequence
  Description of Artificial Sequence: Synthetic polypeptide
EVQLLESGGGLVQPGGSLRLSCAASGFTFSPYNMYWVRQAPGKGLEWVSSIRPSGGGTVYADSVKGRFTISRDNSKNTLYLQMNSLRAEDTAVYYCAGGFIAARWYYFDYWGQGTLVTVSSASTKGPSVFPLAPSSKS

SEQ ID NO: 241 - protein, 106 aa, Artificial Sequence
  Description of Artificial Sequence: Synthetic polypeptide
QSVLTQPPSVSVSPGQTATITCSGDQLGDKYVGWYQQKPGQSPILVIYQDTKRPSGIPERFSGSNSGNTATLTISGTHTVDEAHYYCQAWDTSTAGFGGGTKLTVL

SEQ ID NO: 242 - protein, 139 aa, Artificial Sequence
  Description of Artificial Sequence: Synthetic polypeptide
EVQLLESGGGLVQPGGSLRLSCAASGFTFSWYTMVWVRQAPGKGLEWVSRIYPSGGWTKYADSVKGRFTISRDNSKNTLYLQMNSLRAEDTATYYCAREGLLWFGENAFDIWGQGTMVTVSSASTKGPSVFPLAPSSKS

SEQ ID NO: 243 - protein, 106 aa, Artificial Sequence; identical to SEQ ID NO: 233
  Description of Artificial Sequence: Synthetic polypeptide

SEQ ID NO: 244 - protein, 139 aa, Artificial Sequence; identical to SEQ ID NO: 234
  Description of Artificial Sequence: Synthetic polypeptide

SEQ ID NO: 245 - protein, 106 aa, Artificial Sequence; identical to SEQ ID NO: 241
  Description of Artificial Sequence: Synthetic polypeptide

SEQ ID NO: 246 - protein, 139 aa, Artificial Sequence; identical to SEQ ID NO: 242
  Description of Artificial Sequence: Synthetic polypeptide

SEQ ID NO: 247 - protein, 106 aa, Artificial Sequence
  Description of Artificial Sequence: Synthetic polypeptide
QSALTQPPTVSVSPGQTARITCSGNKLGDKYVAWYQQKPGQSPMLVIYQDTKRPSRVSERFSGSNSANTATLSISGTQALDEADYYCQAWDSSIVIFGGGTRLTVL

SEQ ID NO: 248 - protein, 139 aa, Artificial Sequence
  Description of Artificial Sequence: Synthetic polypeptide
EVQLLESGGGLVQPGGSLRLSCAASGFTFSWYTMVWVRQAPGKGLEWVSYIYPSGGATFYADSVKGRFTISRDNSKNTLYLQMNSLRAEDTAVYYCAMGSYDYIWGFYSDHWGQGTLVTVSSASTKGPSVFPLAPSSKS

SEQ ID NO: 249 - protein, 105 aa, Artificial Sequence
  Description of Artificial Sequence: Synthetic polypeptide
QYELTQPPSVSVSPGQTATITCSGDNLGNKYNSWYQQKPGQSPLLVIYQDTKRPSAIPERFSGSNSGNTATLTISGTQAMDEADYYCQAWDGNVVFGGGTKLTVL

SEQ ID NO: 250 - protein, 144 aa, Artificial Sequence
  Description of Artificial Sequence: Synthetic polypeptide
EVQLLESGGGLVQPGGSLRLSCAASGFTFSWYEMGWVRQAPGKGLEWVSSIYSSGGGTMYADSVKGRFTISRDNSKNTLYLQMNSLRAEDTAVYYCARNPQYSGYDRSLSDGAFDIWGQGTMVTVSSASTKGPSVFPLAPSSKS

SEQ ID NO: 251 - protein, 110 aa, Artificial Sequence
  Description of Artificial Sequence: Synthetic polypeptide
QDIQMTQSPATLSLSPGERATLSCRASQSVSSYLAWYQQKPGQAPRLLIYDASNRATGIPARFSGSGSGTDFTLTISSLEPEDFAVYYCQQRSNWPRGFTFGPGTKVDIK

SEQ ID NO: 252 - protein, 145 aa, Artificial Sequence
  Description of Artificial Sequence: Synthetic polypeptide
EVQLLESGGGLVQPGGSLRLSCAASGFTFSYYHMSWVRQAPGKGLEWVSVISPSGGSTKYADSVKGRFTISRDNSKNTLYLQMNSLRAEDTAVYYCARGGSSDYAWGSYRRPYYFDYWGQGTLVTVSSASTKGPSVFPLAPSSKS

SEQ ID NO: 253 - protein, 106 aa, Artificial Sequence
  Description of Artificial Sequence: Synthetic polypeptide
QSVLTQPPSVSVSPGQTASITCSGEKLGDKYVSWYQQKPGQSPSLVICEDSRRPSGIPERFSGSNSGNTATLTISGAQPMDEADYYCQAWDSSTAIFGPGTKVTVL

SEQ ID NO: 254 - protein, 141 aa, Artificial Sequence
  Description of Artificial Sequence: Synthetic polypeptide
EVQLLESGGGLVQPGGSLRLSCAASGFTFSYYMMVWVRQAPGKGLEWVSYIYSSGGHTVYADSVKGRFTISRDNSKNTLYLQMNSLRAEDTAVYYCARDLFLYDFWSKGAFDIWGQGTMVTVSSASTKGPSVFPLAPSSKS

SEQ ID NO: 255 - protein, 107 aa, Artificial Sequence
  Description of Artificial Sequence: Synthetic polypeptide
QSVLTQPPSVSVSPGQTASITCSGDKLGDKYTSWYQQRPGQSPVLVIYQDIKRPSGIPERFSGSNSGNTATLTISGTQAMDEADYYCQAWDSPNARVFGSGTKVTVL

SEQ ID NO: 256 - protein, 145 aa, Artificial Sequence
  Description of Artificial Sequence: Synthetic polypeptide
EVQLLESGGGLVQPGGSLRLSCAASGFTFSHYRMSWVRQAPGKGLEWVSSIYPSGGRTVYADSVKGRFTISRDNSKNTLYLQMNSLRAEDTAVYYCAKDKFEWRLLFRGIGNDAFDIWGQGTMVTVSSASTKGPSVFPLAPSSKS

SEQ ID NO: 257 - protein, 110 aa, Artificial Sequence
  Description of Artificial Sequence: Synthetic polypeptide
QSELTQPPSASETPGQRVTISCSGSSSNIGSNTVSWFQQLPGSAPRLLIYNDHRRPSGVPDRFSGSKSGTSASLVISGLQSQDEADYYCSAWDDSLNGVVFGGGTKLTVL

SEQ ID NO: 258 - protein, 146 aa, Artificial Sequence
  Description of Artificial Sequence: Synthetic polypeptide
EVQLLESGGGLVQPGGSLRLSCAASGFTFSRYEMYWVRQAPGKGLEWVSSISSSGGPTAYADSVKGRFTISRDNSKNTLYLQMNSLRAEDTAMYYCAKGTPKWELLLRSIYIENAFDIWGQGTMVTVSSASTKGPSVFPLAPSSKS

SEQ ID NO: 259 - protein, 112 aa, Artificial Sequence
  Description of Artificial Sequence: Synthetic polypeptide
QDIVMTQTPPSLPVNPGEPASISCRSSQSLSDDGNTYLDWYLQRPGQSPQLLIHTLSYRASGVPDRFSGSGSGTDFTLKISRVEAEDVGVYYCMQGTHWPPTFGQGTKVEIK

SEQ ID NO: 260 - protein, 138 aa, Artificial Sequence
  Description of Artificial Sequence: Synthetic polypeptide
EVQLLESGGGLVQPGGSLRLSCAASGFTFSFYAMHWVRQAPGKGLEWVSGIVPSGGRTHYADSVKGRFTISRDNSKNTLYLQMNSLRAEDTAVYYCATDSSGSPNPLFDYWGQGTLVTVSSASTKGPSVFPLAPSPKS

SEQ ID NO: 261 - protein, 113 aa, Artificial Sequence
  Description of Artificial Sequence: Synthetic polypeptide
QDIQMTQSPLSLSVTPGEPASISCRSSLSLLHSNGYNYLDWYVQRPGQSPQLLMYLSSTRASGVPDRFSGSGSGTDFTLEISRVEAEDVGVYYCMQPLETPPTFGGGTKVEIK

SEQ ID NO: 262 - protein, 142 aa, Artificial Sequence
  Description of Artificial Sequence: Synthetic polypeptide
EVQLLESGGGLVQPGGSLRLSCAASGFTFSYYEMDWVRQAPGKGLEWVSGISSSGGHTAYADSVKGRFTISRDNSKNTLYLQMNSLRAEDTATYYCARERRSSSRARYYYGMDVWGQGTTVTVSSASTKGPSVFPLAPSSKS

SEQ ID NO: 263 - protein, 109 aa, Artificial Sequence
  Description of Artificial Sequence: Synthetic polypeptide
QSVLIQPPSVSGIPGQRVTISCSGNNSNFGSNTVTWYQQLPGTAPKLLIYSDSRRPSGVPDRFSGSRSDTSASLAISGLQSEDEAEYHCAAWDDSLNGVFGGGTKLTVL

SEQ ID NO: 264 - protein, 147 aa, Artificial Sequence
  Description of Artificial Sequence: Synthetic polypeptide
EVQLLESGGGLVQPGGSLRLSCAASGFTFSDYRMQWVRQAPGKGLEWVSVIVPSGGNTMYADSVKGRFTISRDNSKNTLYLQMNSLRAEDTAVYYCARGGPGSSIAARRAPTGYYGMDVWGQGTTVTVSSASTKGPSVFPLAPSSKS

SEQ ID NO: 265 - protein, 108 aa, Artificial Sequence
  Description of Artificial Sequence: Synthetic polypeptide
QDIQMTQSPSSLSAFVGDRVTITCRASQPIDNYLNWYHQKPGKAPKLLIYAASRLQSGVPSRLSGSGFGTDFTLTISSLQPEDFGNYYCQQSYTVPYTFGGGTKVEIR

SEQ ID NO: 266 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRELKSNYFDYWGQGTLVTVSSASTKGPSVFPLAPSSKS

SEQ ID NO: 267 - protein, 110 aa, Artificial Sequence; identical to SEQ ID NO: 251
  Description of Artificial Sequence: Synthetic polypeptide

SEQ ID NO: 268 - protein, 145 aa, Artificial Sequence; identical to SEQ ID NO: 252
  Description of Artificial Sequence: Synthetic polypeptide

SEQ ID NO: 269 - protein, 107 aa, Artificial Sequence; identical to SEQ ID NO: 255
  Description of Artificial Sequence: Synthetic polypeptide

SEQ ID NO: 270 - protein, 145 aa, Artificial Sequence; identical to SEQ ID NO: 256
  Description of Artificial Sequence: Synthetic polypeptide

SEQ ID NO: 271 - protein, 108 aa, Artificial Sequence
  Description of Artificial Sequence: Synthetic polypeptide
QDIQMTQSPSSLSASVGDRVTITCRASGDIGNALGWYQQKPGKAPRLLISDASTLQSGVPLRFSGSGSGTEFTLTISSLQPEDFATYYCLQGYNYPRTFGQGTKLEIR

SEQ ID NO: 272 - protein, 141 aa, Artificial Sequence
  Description of Artificial Sequence: Synthetic polypeptide
EVQLLESGGGLVQPGGSLRLSCAASGFTFSRYIMHWVRQAPGKGLEWVSSISPSGGLTSYADSVKGRFTISRDNSKNTLYLQMNSLRAEDTAVYYCAREFENAYHYYYYGMDVWGQGTTVTVSSASTKGPSVFPLAPSSKS

SEQ ID NO: 273 - protein, 108 aa, Artificial Sequence
  Description of Artificial Sequence: Synthetic polypeptide
QDIQMTQSPSSLSASVGDRVTITCRASQSISSYLSWYQQRPGKAPNLLIYAASSLQSGVPSRFSGSGSGTDFTLTISSLQPEDFATYYCQQSISIPRTFGQGTKVEVK

SEQ ID NO: 274 - protein, 146 aa, Artificial Sequence
  Description of Artificial Sequence: Synthetic polypeptide
EVQLLESGGGLVQPGGSLRLSCAASGFTFSPYFMGWVRQAPGKGLEWVSGIGPSGGSTTYADSVKGRFTISRDNSKNTLYLQMNSLRAEDTAVYYCAREGPPYSSGWYRGLRQYHFDYWGQGTLVTVSSASTKGPSVFPLAPSSKS

SEQ ID NO: 275 - protein, 108 aa, Artificial Sequence
  Description of Artificial Sequence: Synthetic polypeptide
QDIQMTQSPSFLSASVGDRVTITCRASQGISSYLAWYQQKPGKAPKLLIYAASTLQSGVPSRFSGSGSGTEFTLTISSLQPEDFATYYCQQLNSYPLTFGGGTKVEIK

SEQ ID NO: 276 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDYWGQGTLVTVSSASTKGPSVFPLAPSSKS

SEQ ID NO: 277 - protein, 106 aa, Artificial Sequence
  Description of Artificial Sequence: Synthetic polypeptide
QSALTQPPSVSVSPGQTASITCSGDKLGDKYVSWYQQRPGQSPVLVIYQDTKRPSGIPERFSGSNSGNTATLTISGTQAVDEADYYCQAWDSSTYVFGGGTKVTVL

SEQ ID NO: 278 - protein, 147 aa, Artificial Sequence
  Description of Artificial Sequence: Synthetic polypeptide
EVQLLESGGGLVQPGGSLRLSCAASGFTFSDYAMKWVRQAPGKGLEWVSSISSSGGVTQYADSVKGRFTISRDNSKNTLYLQMNSLRAEDTAVYYCAREEDYSSSWYSRRFDYYYGMDVWGQGTTVTVSSASTKGPSVFPLAPSSKS

SEQ ID NO: 279 - protein, 107 aa, Artificial Sequence
  Description of Artificial Sequence: Synthetic polypeptide
QDIQMTQSPSTLSASVGDRVTITCRASQSISSWLAWYQQKPGKAPNLLIYKASTLESGVPSRFSGSGSGTEFTLTISSLQPDDFATYYCQQYNTYWTFGQGTKVEIK

SEQ ID NO: 280 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDAFDIWGQGTMVTVSSASTKGPSVFPLAPSSKS

SEQ ID NO: 281 - protein, 108 aa, Artificial Sequence; identical to SEQ ID NO: 265
  Description of Artificial Sequence: Synthetic polypeptide

SEQ ID NO: 282 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWSRELKSNYFDYWGQGTLVTVSSASTKGPSVFPLAPSSKS

SEQ ID NO: 283 - protein, 108 aa, Artificial Sequence; identical to SEQ ID NO: 265
  Description of Artificial Sequence: Synthetic polypeptide

SEQ ID NO: 284 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWMRELKSNYFDYWGQGTLVTVSSASTKGPSVFPLAPSSKS

SEQ ID NO: 285 - protein, 108 aa, Artificial Sequence; identical to SEQ ID NO: 265
  Description of Artificial Sequence: Synthetic polypeptide

SEQ ID NO: 286 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWGRELKSNYFDYWGQGTLVTVSSASTKGPSVFPLAPSSKS

SEQ ID NO: 287 - protein, 108 aa, Artificial Sequence; identical to SEQ ID NO: 265
  Description of Artificial Sequence: Synthetic polypeptide

SEQ ID NO: 288 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWNRELKSNYFDYWGQGTLVTVSSASTKGPSVFPLAPSSKS

SEQ ID NO: 289 - protein, 108 aa, Artificial Sequence; identical to SEQ ID NO: 265
  Description of Artificial Sequence: Synthetic polypeptide

SEQ ID NO: 290 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWDRELKSNYFDYWGQGTLVTVSSASTKGPSVFPLAPSSKS

SEQ ID NO: 291 - protein, 108 aa, Artificial Sequence; identical to SEQ ID NO: 265
  Description of Artificial Sequence: Synthetic polypeptide

SEQ ID NO: 292 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWQRELKSNYFDYWGQGTLVTVSSASTKGPSVFPLAPSSKS

SEQ ID NO: 293 - protein, 108 aa, Artificial Sequence; identical to SEQ ID NO: 265
  Description of Artificial Sequence: Synthetic polypeptide

SEQ ID NO: 294 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWTRELKSNYFDYWGQGTLVTVSSASTKGPSVFPLAPSSKS

SEQ ID NO: 295 - protein, 108 aa, Artificial Sequence; identical to SEQ ID NO: 265
  Description of Artificial Sequence: Synthetic polypeptide

SEQ ID NO: 296 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWARELKSNYFDYWGQGTLVTVSSASTKGPSVFPLAPSSKS

SEQ ID NO: 297 - protein, 108 aa, Artificial Sequence; identical to SEQ ID NO: 265
  Description of Artificial Sequence: Synthetic polypeptide

SEQ ID NO: 298 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWERELKSNYFDYWGQGTLVTVSSASTKGPSVFPLAPSSKS

SEQ ID NO: 299 - protein, 11 aa, Artificial Sequence
  Description of Artificial Sequence: Synthetic peptide
RASQSISMYLN

SEQ ID NO: 300 - protein, 7 aa, Artificial Sequence
  Description of Artificial Sequence: Synthetic peptide
GTSSLQS

SEQ ID NO: 301 - protein, 9 aa, Artificial Sequence
  Description of Artificial Sequence: Synthetic peptide
QQSYSAPWT

SEQ ID NO: 302 - protein, 5 aa, Artificial Sequence
  Description of Artificial Sequence: Synthetic peptide
LYQMT

SEQ ID NO: 303 - protein, 17 aa, Artificial Sequence
  Description of Artificial Sequence: Synthetic peptide
GIWPSGGFTDYADSVKG

SEQ ID NO: 304 - protein, 10 aa, Artificial Sequence
  Description of Artificial Sequence: Synthetic peptide
VSTAVADNDY

SEQ ID NO: 305 - protein, 11 aa, Artificial Sequence
  Description of Artificial Sequence: Synthetic peptide
RASQRISFYLN

SEQ ID NO: 306 - protein, 7 aa, Artificial Sequence
  Description of Artificial Sequence: Synthetic peptide
GASSLQS

SEQ ID NO: 307 - protein, 9 aa, Artificial Sequence
  Description of Artificial Sequence: Synthetic peptide
QQTFSTPNT

SEQ ID NO: 308 - protein, 5 aa, Artificial Sequence
  Description of Artificial Sequence: Synthetic peptide
PYPMQ

SEQ ID NO: 309 - protein, 17 aa, Artificial Sequence
  Description of Artificial Sequence: Synthetic peptide
SISSSGGMTEYADSVKG

SEQ ID NO: 310 - protein, 12 aa, Artificial Sequence
  Description of Artificial Sequence: Synthetic peptide
DDYGGKGGAFDI

SEQ ID NO: 311 - protein, 11 aa, Artificial Sequence
  Description of Artificial Sequence: Synthetic peptide
RASQSISSYLN

SEQ ID NO: 312 - protein, 7 aa, Artificial Sequence
  Description of Artificial Sequence: Synthetic peptide
AASSLQS

SEQ ID NO: 313 - protein, 9 aa, Artificial Sequence
  Description of Artificial Sequence: Synthetic peptide
QQSYSTLWT

SEQ ID NO: 314 - protein, 5 aa, Artificial Sequence
  Description of Artificial Sequence: Synthetic peptide
KYFMG

SEQ ID NO: 315 - protein, 17 aa, Artificial Sequence
  Description of Artificial Sequence: Synthetic peptide
VIGSSGGWTSYADSVKG

SEQ ID NO: 316 - protein, 10 aa, Artificial Sequence
  Description of Artificial Sequence: Synthetic peptide
VSTAVADNDY

SEQ ID NO: 317 - protein, 11 aa, Artificial Sequence
  Description of Artificial Sequence: Synthetic peptide
RASQSISSYLN

SEQ ID NO: 318 - protein, 7 aa, Artificial Sequence
  Description of Artificial Sequence: Synthetic peptide
GASSLQS

SEQ ID NO: 319 - protein, 8 aa, Artificial Sequence
  Description of Artificial Sequence: Synthetic peptide
QQSYTRWT

SEQ ID NO: 320 - protein, 5 aa, Artificial Sequence
  Description of Artificial Sequence: Synthetic peptide
RYHMV

SEQ ID NO: 321 - protein, 17 aa, Artificial Sequence
  Description of Artificial Sequence: Synthetic peptide
SISPSGGWTNYADSVKG

SEQ ID NO: 322 - protein, 11 aa, Artificial Sequence
  Description of Artificial Sequence: Synthetic peptide
EMATIAGQFDP

SEQ ID NO: 323 - protein, 11 aa, Artificial Sequence
  Description of Artificial Sequence: Synthetic peptide
RASQSISTYLN

SEQ ID NO: 324 - protein, 7 aa, Artificial Sequence
  Description of Artificial Sequence: Synthetic peptide
NAFSMER

SEQ ID NO: 325 - protein, 9 aa, Artificial Sequence
  Description of Artificial Sequence: Synthetic peptide
QQSYTTPTT

SEQ ID NO: 326 - protein, 5 aa, Artificial Sequence
  Description of Artificial Sequence: Synthetic peptide
RYRMV

SEQ ID NO: 327 - protein, 17 aa, Artificial Sequence
  Description of Artificial Sequence: Synthetic peptide
SIYPSGGMTAYADSVKG

SEQ ID NO: 328 - protein, 11 aa, Artificial Sequence
  Description of Artificial Sequence: Synthetic peptide
DAVGIGDAFDI

SEQ ID NO: 329 - protein, 11 aa, Artificial Sequence
  Description of Artificial Sequence: Synthetic peptide
SGDKLGDKYTS

SEQ ID NO: 330 - protein, 7 aa, Artificial Sequence
  Description of Artificial Sequence: Synthetic peptide
QDSKRPS

SEQ ID NO: 331 - protein, 8 aa, Artificial Sequence
  Description of Artificial Sequence: Synthetic peptide
QAWDSSTV

SEQ ID NO: 332 - protein, 5 aa, Artificial Sequence
  Description of Artificial Sequence: Synthetic peptide
YYPMQ

SEQ ID NO: 333 - protein, 17 aa, Artificial Sequence
  Description of Artificial Sequence: Synthetic peptide
YIYPSGGLTSYADSVKG

SEQ ID NO: 334 - protein, 12 aa, Artificial Sequence
  Description of Artificial Sequence: Synthetic peptide
LFYGSGSVGFEY

SEQ ID NO: 335 - protein, 11 aa, Artificial Sequence
  Description of Artificial Sequence: Synthetic peptide
RASQDISSWLV

SEQ ID NO: 336 - protein, 7 aa, Artificial Sequence
  Description of Artificial Sequence: Synthetic peptide
DASNLQS

SEQ ID NO: 337 - protein, 9 aa, Artificial Sequence
  Description of Artificial Sequence: Synthetic peptide
QQADGFPLT

SEQ ID NO: 338 - protein, 5 aa, Artificial Sequence
  Description of Artificial Sequence: Synthetic peptide
LYNMN

SEQ ID NO: 339 - protein, 17 aa, Artificial Sequence
  Description of Artificial Sequence: Synthetic peptide
SISPSGGFTDYADSVKG

SEQ ID NO: 340 - protein, 9 aa, Artificial Sequence
  Description of Artificial Sequence: Synthetic peptide
DLDLGILDY

SEQ ID NO: 341 - protein, 11 aa, Artificial Sequence
  Description of Artificial Sequence: Synthetic peptide
RASQSISSYLN

SEQ ID NO: 342 - protein, 7 aa, Artificial Sequence
  Description of Artificial Sequence: Synthetic peptide
AASSLQS

SEQ ID NO: 343 - protein, 10 aa, Artificial Sequence
  Description of Artificial Sequence: Synthetic peptide
QQSYSTLMYT

SEQ ID NO: 344 - protein, 5 aa, Artificial Sequence
  Description of Artificial Sequence: Synthetic peptide
HYFMT

SEQ ID NO: 345 - protein, 17 aa, Artificial Sequence
  Description of Artificial Sequence: Synthetic peptide
SIVPSGGMTQYADSVKG

SEQ ID NO: 346 - protein, 10 aa, Artificial Sequence
  Description of Artificial Sequence: Synthetic peptide
DSYSSSWFDI

SEQ ID NO: 347 - protein, 11 aa, Artificial Sequence
  Description of Artificial Sequence: Synthetic peptide
RASQGVSYYLA

SEQ ID NO: 348 - protein, 7 aa, Artificial Sequence
  Description of Artificial Sequence: Synthetic peptide
GASSLQS

SEQ ID NO: 349 - protein, 9 aa, Artificial Sequence
  Description of Artificial Sequence: Synthetic peptide
QQYNTYPPT

SEQ ID NO: 350 - protein, 5 aa, Artificial Sequence
  Description of Artificial Sequence: Synthetic peptide
LYEML

SEQ ID NO: 351 - protein, 17 aa, Artificial Sequence
  Description of Artificial Sequence: Synthetic peptide
VIYPSGGYTDYADSVKG

SEQ ID NO: 352 - protein, 10 aa, Artificial Sequence
  Description of Artificial Sequence: Synthetic peptide
SFSGFGEIDY

SEQ ID NO: 353 - protein, 11 aa, Artificial Sequence
  Description of Artificial Sequence: Synthetic peptide
RASQYISTYLN

SEQ ID NO: 354 - protein, 7 aa, Artificial Sequence
  Description of Artificial Sequence: Synthetic peptide
GTSSLQS

SEQ ID NO: 355 - protein, 9 aa, Artificial Sequence
  Description of Artificial Sequence: Synthetic peptide
QQSFTTPFT

SEQ ID NO: 356 - protein, 5 aa, Artificial Sequence
  Description of Artificial Sequence: Synthetic peptide
GYWMG

SEQ ID NO: 357 - protein, 17 aa, Artificial Sequence
  Description of Artificial Sequence: Synthetic peptide
SISSSGGWTQYADSVKG

SEQ ID NO: 358 - protein, 12 aa, Artificial Sequence
  Description of Artificial Sequence: Synthetic peptide
DDEIAAGGAFDI

SEQ ID NO: 359 - protein, 11 aa, Artificial Sequence
  Description of Artificial Sequence: Synthetic peptide
RASQNIDIYLN

SEQ ID NO: 360 - protein, 7 aa, Artificial Sequence
  Description of Artificial Sequence: Synthetic peptide
GAYNLQS

SEQ ID NO: 361 - protein, 8 aa, Artificial Sequence
  Description of Artificial Sequence: Synthetic peptide
QQSYGTPV

SEQ ID NO: 362 - protein, 5 aa, Artificial Sequence
  Description of Artificial Sequence: Synthetic peptide
GYFMM

SEQ ID NO: 363 - protein, 17 aa, Artificial Sequence
  Description of Artificial Sequence: Synthetic peptide
SIYSSGGYTDYADSVKG

SEQ ID NO: 364 - protein, 10 aa, Artificial Sequence
  Description of Artificial Sequence: Synthetic peptide
EVAGTYAFDI

SEQ ID NO: 365 - protein, 11 aa, Artificial Sequence
  Description of Artificial Sequence: Synthetic peptide
RASQRISTYLN

SEQ ID NO: 366 - protein, 7 aa, Artificial Sequence
  Description of Artificial Sequence: Synthetic peptide
GASSLQS

SEQ ID NO: 367 - protein, 9 aa, Artificial Sequence
  Description of Artificial Sequence: Synthetic peptide
QQSYNTPRT

SEQ ID NO: 368 - protein, 5 aa, Artificial Sequence
  Description of Artificial Sequence: Synthetic peptide
AYEMW

SEQ ID NO: 369 - protein, 17 aa, Artificial Sequence
  Description of Artificial Sequence: Synthetic peptide
YIGSSGGSTSYADSVKG

SEQ ID NO: 370 - protein, 11 aa, Artificial Sequence
  Description of Artificial Sequence: Synthetic peptide
GNSSSFDAFDI

SEQ ID NO: 371 - protein, 11 aa, Artificial Sequence
  Description of Artificial Sequence: Synthetic peptide
RASQSISIYVN

SEQ ID NO: 372 - protein, 7 aa, Artificial Sequence
  Description of Artificial Sequence: Synthetic peptide
AASSLQR

SEQ ID NO: 373 - protein, 9 aa, Artificial Sequence
  Description of Artificial Sequence: Synthetic peptide
QQSFSTPLT

SEQ ID NO: 374 - protein, 5 aa, Artificial Sequence
  Description of Artificial Sequence: Synthetic peptide
HYGMV

SEQ ID NO: 375 - protein, 17 aa, Artificial Sequence
  Description of Artificial Sequence: Synthetic peptide
YIVPSGGLTYYADSVKG

SEQ ID NO: 376 - protein, 10 aa, Artificial Sequence
  Description of Artificial Sequence: Synthetic peptide
VDYTGDGLGY

SEQ ID NO: 377 - protein, 11 aa, Artificial Sequence
  Description of Artificial Sequence: Synthetic peptide
RASQGISSYLN

SEQ ID NO: 378 - protein, 7 aa, Artificial Sequence
  Description of Artificial Sequence: Synthetic peptide
GASSLQS

SEQ ID NO: 379 - protein, 9 aa, Artificial Sequence
  Description of Artificial Sequence: Synthetic peptide
QESYSTLFT

SEQ ID NO: 380 - protein, 5 aa, Artificial Sequence
  Description of Artificial Sequence: Synthetic peptide
LYPMQ

SEQ ID NO: 381 - protein, 17 aa, Artificial Sequence
  Description of Artificial Sequence: Synthetic peptide
SIGSSGGMTFYADSVKG

SEQ ID NO: 382 - protein, 11 aa, Artificial Sequence
  Description of Artificial Sequence: Synthetic peptide
EVGAAGFAFDI

SEQ ID NO: 383 - protein, 11 aa, Artificial Sequence
  Description of Artificial Sequence: Synthetic peptide
RASRTISFYLN

SEQ ID NO: 384 - protein, 7 aa, Artificial Sequence
  Description of Artificial Sequence: Synthetic peptide
GGSSLHS

SEQ ID NO: 385 - protein, 9 aa, Artificial Sequence
  Description of Artificial Sequence: Synthetic peptide
QQSFSSPWT

SEQ ID NO: 386 - protein, 5 aa, Artificial Sequence
  Description of Artificial Sequence: Synthetic peptide
WYKMM

SEQ ID NO: 387 - protein, 17 aa, Artificial Sequence
  Description of Artificial Sequence: Synthetic peptide
SIYPSGGWTNYADSVKG

SEQ ID NO: 388 - protein, 11 aa, Artificial Sequence
  Description of Artificial Sequence: Synthetic peptide
GSPWGDDAFDI

SEQ ID NO: 389 - protein, 11 aa, Artificial Sequence
  Description of Artificial Sequence: Synthetic peptide
RASQSISGYLN

SEQ ID NO: 390 - protein, 7 aa, Artificial Sequence
  Description of Artificial Sequence: Synthetic peptide
AASNLQT

SEQ ID NO: 391 - protein, 9 aa, Artificial Sequence
  Description of Artificial Sequence: Synthetic peptide
QQSHTPPKT

SEQ ID NO: 392 - protein, 5 aa, Artificial Sequence
  Description of Artificial Sequence: Synthetic peptide
EYDMM

SEQ ID NO: 393 - protein, 17 aa, Artificial Sequence
  Description of Artificial Sequence: Synthetic peptide
SIGSSGGMTYYADSVKG

SEQ ID NO: 394 - protein, 10 aa, Artificial Sequence
  Description of Artificial Sequence: Synthetic peptide
DQVAAAAIDY

SEQ ID NO: 395 - protein, 11 aa, Artificial Sequence
  Description of Artificial Sequence: Synthetic peptide
RASQSISSYLN

SEQ ID NO: 396 - protein, 7 aa, Artificial Sequence
  Description of Artificial Sequence: Synthetic peptide
AASSLQS

SEQ ID NO: 397 - protein, 10 aa, Artificial Sequence
  Description of Artificial Sequence: Synthetic peptide
QQSYSTPPYT

SEQ ID NO: 398 - protein, 5 aa, Artificial Sequence
  Description of Artificial Sequence: Synthetic peptide
PYAMT

SEQ ID NO: 399 - protein, 17 aa, Artificial Sequence
  Description of Artificial Sequence: Synthetic peptide
VIYPSGGFTDYADSVKG

SEQ ID NO: 400 - protein, 11 aa, Artificial Sequence
  Description of Artificial Sequence: Synthetic peptide
ASGSYLDAFDI

SEQ ID NO: 401 - protein, 11 aa, Artificial Sequence
  Description of Artificial Sequence: Synthetic peptide
RASQSISSYLN

SEQ ID NO: 402 - protein, 7 aa, Artificial Sequence
  Description of Artificial Sequence: Synthetic peptide
AASSLQS

SEQ ID NO: 403 - protein, 9 aa, Artificial Sequence
  Description of Artificial Sequence: Synthetic peptide
QQTYTTPWT

SEQ ID NO: 404 - protein, 5 aa, Artificial Sequence
  Description of Artificial Sequence: Synthetic peptide
SYPMG

SEQ ID NO: 405 - protein, 17 aa, Artificial Sequence
  Description of Artificial Sequence: Synthetic peptide
RISSSGGMTIYADSVKG

SEQ ID NO: 406 - protein, 9 aa, Artificial Sequence
  Description of Artificial Sequence: Synthetic peptide
DDWNVGMDV

SEQ ID NO: 407 - protein, 11 aa, Artificial Sequence
  Description of Artificial Sequence: Synthetic peptide
RASQSINTYLN

SEQ ID NO: 408 - protein, 7 aa, Artificial Sequence
  Description of Artificial Sequence: Synthetic peptide
AASTLES

SEQ ID NO: 409 - protein, 9 aa, Artificial Sequence
  Description of Artificial Sequence: Synthetic peptide
QQSYSTPYT

SEQ ID NO: 410 - protein, 5 aa, Artificial Sequence
  Description of Artificial Sequence: Synthetic peptide
DYDME

SEQ ID NO: 411 - protein, 17 aa, Artificial Sequence
  Description of Artificial Sequence: Synthetic peptide
SISPSGGSTIYADSVKG

SEQ ID NO: 412 - protein, 9 aa, Artificial Sequence
  Description of Artificial Sequence: Synthetic peptide
QGLLTAFDI

SEQ ID NO: 413 - protein, 11 aa, Artificial Sequence
  Description of Artificial Sequence: Synthetic peptide
RASQSISSYLN

SEQ ID NO: 414 - protein, 7 aa, Artificial Sequence
  Description of Artificial Sequence: Synthetic peptide
AASSLQS

SEQ ID NO: 415 - protein, 9 aa, Artificial Sequence
  Description of Artificial Sequence: Synthetic peptide
QQSYSTPIT

SEQ ID NO: 416 - protein, 5 aa, Artificial Sequence
  Description of Artificial Sequence: Synthetic peptide
YYTML

SEQ ID NO: 417 - protein, 17 aa, Artificial Sequence
  Description of Artificial Sequence: Synthetic peptide
SIYPSGGFTMYADSVKG

SEQ ID NO: 418 - protein, 10 aa, Artificial Sequence
  Description of Artificial Sequence: Synthetic peptide
VDTAMAMIDY

SEQ ID NO: 419 - protein, 11 aa, Artificial Sequence
  Description of Artificial Sequence: Synthetic peptide
RASRSIATYLN

SEQ ID NO: 420 - protein, 7 aa, Artificial Sequence
  Description of Artificial Sequence: Synthetic peptide
GASTLQS

SEQ ID NO: 421 - protein, 9 aa, Artificial Sequence
  Description of Artificial Sequence: Synthetic peptide
QQSFSDPYT

SEQ ID NO: 422 - protein, 5 aa, Artificial Sequence
  Description of Artificial Sequence: Synthetic peptide
AYMMI

SEQ ID NO: 423 - protein, 17 aa, Artificial Sequence
  Description of Artificial Sequence: Synthetic peptide
VIYPSGGVTMYADSVKG

SEQ ID NO: 424 - protein, 11 aa, Artificial Sequence
  Description of Artificial Sequence: Synthetic peptide
GTVGASDAFDI

SEQ ID NO: 425 - protein, 11 aa, Artificial Sequence
  Description of Artificial Sequence: Synthetic peptide
SGDKLGNRYTS

SEQ ID NO: 426 - protein, 7 aa, Artificial Sequence
  Description of Artificial Sequence: Synthetic peptide
QDNKRPS

SEQ ID NO: 427 - protein, 9 aa, Artificial Sequence
  Description of Artificial Sequence: Synthetic peptide
QALDSNTYV

SEQ ID NO: 428 - protein, 5 aa, Artificial Sequence
  Description of Artificial Sequence: Synthetic peptide
WYSMG

SEQ ID NO: 429 - protein, 17 aa, Artificial Sequence
  Description of Artificial Sequence: Synthetic peptide
YIVPSGGYTMYADSVKG

SEQ ID NO: 430 - protein, 13 aa, Artificial Sequence
  Description of Artificial Sequence: Synthetic peptide
DPGVSYYYYGMDV

SEQ ID NO: 431 - protein, 11 aa, Artificial Sequence
  Description of Artificial Sequence: Synthetic peptide
RASQSISSYLN

SEQ ID NO: 432 - protein, 7 aa, Artificial Sequence
  Description of Artificial Sequence: Synthetic peptide
AASSLQS

SEQ ID NO: 433 - protein, 9 aa, Artificial Sequence
  Description of Artificial Sequence: Synthetic peptide
QQSYSTPPT

SEQ ID NO: 434 - protein, 5 aa, Artificial Sequence
  Description of Artificial Sequence: Synthetic peptide
AYTMW

SEQ ID NO: 435 - protein, 17 aa, Artificial Sequence
  Description of Artificial Sequence: Synthetic peptide
SIWPSGGSTFYADSVKG

SEQ ID NO: 436 - protein, 11 aa, Artificial Sequence
  Description of Artificial Sequence: Synthetic peptide
TYDSSAGEVDY

SEQ ID NO: 437 - protein, 11 aa, Artificial Sequence
  Description of Artificial Sequence: Synthetic peptide
RASQRISFYLN

SEQ ID NO: 438 - protein, 7 aa, Artificial Sequence
  Description of Artificial Sequence: Synthetic peptide
GASSLQS

SEQ ID NO: 439 - protein, 9 aa, Artificial Sequence
  Description of Artificial Sequence: Synthetic peptide
QQTFSTPNT

SEQ ID NO: 440 - protein, 5 aa, Artificial Sequence
  Description of Artificial Sequence: Synthetic peptide
PYPMQ

SEQ ID NO: 441 - protein, 17 aa, Artificial Sequence
  Description of Artificial Sequence: Synthetic peptide
SISSSGGMTEYADSVKG

SEQ ID NO: 442 - protein, 12 aa, Artificial Sequence
  Description of Artificial Sequence: Synthetic peptide
DDYGGKGGAFDI

SEQ ID NO: 443 - protein, 11 aa, Artificial Sequence
  Description of Artificial Sequence: Synthetic peptide
RASRDISVYLN

SEQ ID NO: 444 - protein, 7 aa, Artificial Sequence
  Description of Artificial Sequence: Synthetic peptide
GASSLQS

SEQ ID NO: 445 - protein, 9 aa, Artificial Sequence
  Description of Artificial Sequence: Synthetic peptide
QQSYSIPFT

SEQ ID NO: 446 - protein, 5 aa, Artificial Sequence
  Description of Artificial Sequence: Synthetic peptide
LYLMH

SEQ ID NO: 447 - protein, 17 aa, Artificial Sequence
  Description of Artificial Sequence: Synthetic peptide
SIYSSGGFTTYADSVKG

SEQ ID NO: 448 - protein, 8 aa, Artificial Sequence
  Description of Artificial Sequence: Synthetic peptide
DTDYGMDV

SEQ ID NO: 449 - protein, 11 aa, Artificial Sequence
  Description of Artificial Sequence: Synthetic peptide
RASQSISTYLN

SEQ ID NO: 450 - protein, 7 aa, Artificial Sequence
  Description of Artificial Sequence: Synthetic peptide
GASSLQS

SEQ ID NO: 451 - protein, 9 aa, Artificial Sequence
  Description of Artificial Sequence: Synthetic peptide
QQSFSTPWT

SEQ ID NO: 452 - protein, 5 aa, Artificial Sequence
  Description of Artificial Sequence: Synthetic peptide
WYEMS

SEQ ID NO: 453 - protein, 17 aa, Artificial Sequence
  Description of Artificial Sequence: Synthetic peptide
RIWPSGGVTMYADSVKG

SEQ ID NO: 454 - protein, 10 aa, Artificial Sequence
  Description of Artificial Sequence: Synthetic peptide
TSITTVGMDV

SEQ ID NO: 455 - protein, 11 aa, Artificial Sequence
  Description of Artificial Sequence: Synthetic peptide
RASQSISIYLN

SEQ ID NO: 456 - protein, 7 aa, Artificial Sequence
  Description of Artificial Sequence: Synthetic peptide
AASTLQS

SEQ ID NO: 457 - protein, 9 aa, Artificial Sequence
  Description of Artificial Sequence: Synthetic peptide
QQSHSIPPT

SEQ ID NO: 458 - protein, 5 aa, Artificial Sequence
  Description of Artificial Sequence: Synthetic peptide
MYPMM

SEQ ID NO: 459 - protein, 17 aa, Artificial Sequence
  Description of Artificial Sequence: Synthetic peptide
YISPSGGMTDYADSVKG

SEQ ID NO: 460 - protein, 10 aa, Artificial Sequence
  Description of Artificial Sequence: Synthetic peptide
VAGSSDAFDI

SEQ ID NO: 461 - protein, 16 aa, Artificial Sequence
  Description of Artificial Sequence: Synthetic peptide
RSSQSLLHSNGYNYLD

SEQ ID NO: 462 - protein, 7 aa, Artificial Sequence
  Description of Artificial Sequence: Synthetic peptide
LGSNRAS

SEQ ID NO: 463 - protein, 9 aa, Artificial Sequence
  Description of Artificial Sequence: Synthetic peptide
MQALQTPLT

SEQ ID NO: 464 - protein, 5 aa, Artificial Sequence
  Description of Artificial Sequence: Synthetic peptide
AYPMN

SEQ ID NO: 465 - protein, 17 aa, Artificial Sequence
  Description of Artificial Sequence: Synthetic peptide
RISSSGGNTSYADSVKG

SEQ ID NO: 466 - protein, 5 aa, Artificial Sequence
  Description of Artificial Sequence: Synthetic peptide
GYLGY

SEQ ID NO: 467 - protein, 11 aa, Artificial Sequence
  Description of Artificial Sequence: Synthetic peptide
RASQSISTYLN

SEQ ID NO: 468 - protein, 7 aa, Artificial Sequence
  Description of Artificial Sequence: Synthetic peptide
GASSLQS

SEQ ID NO: 469 - protein, 9 aa, Artificial Sequence
  Description of Artificial Sequence: Synthetic peptide
QQSYSDPYT

SEQ ID NO: 470 - protein, 5 aa, Artificial Sequence
  Description of Artificial Sequence: Synthetic peptide
LYRMF

SEQ ID NO: 471 - protein, 17 aa, Artificial Sequence
  Description of Artificial Sequence: Synthetic peptide
SIWSSGGPTMYADSVKG

SEQ ID NO: 472 - protein, 10 aa, Artificial Sequence
  Description of Artificial Sequence: Synthetic peptide
EYPSTYYFDY

SEQ ID NO: 473 - protein, 11 aa, Artificial Sequence
  Description of Artificial Sequence: Synthetic peptide
RASQTIDDDLI

SEQ ID NO: 474 - protein, 7 aa, Artificial Sequence
  Description of Artificial Sequence: Synthetic peptide
AASSLQS

SEQ ID NO: 475 - protein, 9 aa, Artificial Sequence
  Description of Artificial Sequence: Synthetic peptide
QQSYNIPRT

SEQ ID NO: 476 - protein, 5 aa, Artificial Sequence
  Description of Artificial Sequence: Synthetic peptide
NYDMM

SEQ ID NO: 477 - protein, 17 aa, Artificial Sequence
  Description of Artificial Sequence: Synthetic peptide
YISPSGGFTRYADSVKG

SEQ ID NO: 478 - protein, 15 aa, Artificial Sequence
  Description of Artificial Sequence: Synthetic peptide
DIYYYNWGPSHYFDS

SEQ ID NO: 479 - protein, 11 aa, Artificial Sequence
  Description of Artificial Sequence: Synthetic peptide
RASQSISGYIN

SEQ ID NO: 480 - protein, 7 aa, Artificial Sequence
  Description of Artificial Sequence: Synthetic peptide
AASSLQS

SEQ ID NO: 481 - protein, 9 aa, Artificial Sequence
  Description of Artificial Sequence: Synthetic peptide
QQYVSYPFT

SEQ ID NO: 482 - protein, 5 aa, Artificial Sequence
  Description of Artificial Sequence: Synthetic peptide
QYGMQ

SEQ ID NO: 483 - protein, 17 aa, Artificial Sequence
  Description of Artificial Sequence: Synthetic peptide
SIRSSGGATRYADSVKG

SEQ ID NO: 484 - protein, 12 aa, Artificial Sequence
  Description of Artificial Sequence: Synthetic peptide
DGYYDSSGYPDY

SEQ ID NO: 485 - protein, 11 aa, Artificial Sequence
  Description of Artificial Sequence: Synthetic peptide
RASQSIDTYLN

SEQ ID NO: 486 - protein, 5 aa, Artificial Sequence
  Description of Artificial Sequence: Synthetic peptide
DASNL

SEQ ID NO: 487 - protein, 9 aa, Artificial Sequence
  Description of Artificial Sequence: Synthetic peptide
QHYLYAPYS

SEQ ID NO: 488 - protein, 5 aa, Artificial Sequence
  Description of Artificial Sequence: Synthetic peptide
NYWMM

SEQ ID NO: 489 - protein, 17 aa, Artificial Sequence
  Description of Artificial Sequence: Synthetic peptide
GIGSSGGFTSYADSVKG

SEQ ID NO: 490 - protein, 11 aa, Artificial Sequence
  Description of Artificial Sequence: Synthetic peptide
GSYSDYGVFES

SEQ ID NO: 491 - protein, 11 aa, Artificial Sequence
  Description of Artificial Sequence: Synthetic peptide
RASQSISSYLN

SEQ ID NO: 492 - protein, 7 aa, Artificial Sequence
  Description of Artificial Sequence: Synthetic peptide
AASSLQS

SEQ ID NO: 493 - protein, 9 aa, Artificial Sequence
  Description of Artificial Sequence: Synthetic peptide
QQSYSTPPT

SEQ ID NO: 494 - protein, 5 aa, Artificial Sequence
  Description of Artificial Sequence: Synthetic peptide
TYEMY

SEQ ID NO: 495 - protein, 17 aa, Artificial Sequence
  Description of Artificial Sequence: Synthetic peptide
GIGSSGGMTMYADSVKG

SEQ ID NO: 496 - protein, 10 aa, Artificial Sequence
  Description of Artificial Sequence: Synthetic peptide
EQPGIAALQF

SEQ ID NO: 497 - protein, 11 aa, Artificial Sequence
  Description of Artificial Sequence: Synthetic peptide
RASQSISIYLT

SEQ ID NO: 498 - protein, 7 aa, Artificial Sequence
  Description of Artificial Sequence: Synthetic peptide
GAATLQT

SEQ ID NO: 499 - protein, 9 aa, Artificial Sequence
  Description of Artificial Sequence: Synthetic peptide
QQTFSLPRT

SEQ ID NO: 500 - protein, 5 aa, Artificial Sequence
  Description of Artificial Sequence: Synthetic peptide
MYHMN

SEQ ID NO: 501 - protein, 17 aa, Artificial Sequence
  Description of Artificial Sequence: Synthetic peptide
GIVSSGGVTFYADSVKG

SEQ ID NO: 502 - protein, 12 aa, Artificial Sequence
  Description of Artificial Sequence: Synthetic peptide
ITTVTTGGAFDI

SEQ ID NO: 503 - protein, 11 aa, Artificial Sequence
  Description of Artificial Sequence: Synthetic peptide
RTSQTINNYLN

SEQ ID NO: 504 - protein, 7 aa, Artificial Sequence
  Description of Artificial Sequence: Synthetic peptide
ATHTLES

SEQ ID NO: 505 - protein, 9 aa, Artificial Sequence
  Description of Artificial Sequence: Synthetic peptide
QQSFAFPYT

SEQ ID NO: 506 - protein, 5 aa, Artificial Sequence
  Description of Artificial Sequence: Synthetic peptide
WYTMG

SEQ ID NO: 507 - protein, 16 aa, Artificial Sequence
  Description of Artificial Sequence: Synthetic peptide
WIYFGGLTTYADSVKG

SEQ ID NO: 508 - protein, 10 aa, Artificial Sequence
  Description of Artificial Sequence: Synthetic peptide
LGGPLDAFDI

SEQ ID NO: 509 - protein, 11 aa, Artificial Sequence
  Description of Artificial Sequence: Synthetic peptide
RASRGIGTYLN

SEQ ID NO: 510 - protein, 7 aa, Artificial Sequence
  Description of Artificial Sequence: Synthetic peptide
AASSLET

SEQ ID NO: 511 - protein, 9 aa, Artificial Sequence
  Description of Artificial Sequence: Synthetic peptide
QESFTNVYN

SEQ ID NO: 512 - protein, 5 aa, Artificial Sequence
  Description of Artificial Sequence: Synthetic peptide
QYAMH

SEQ ID NO: 513 - protein, 17 aa, Artificial Sequence
  Description of Artificial Sequence: Synthetic peptide
SIYPSGGFTLYADSVKG

SEQ ID NO: 514 - protein, 11 aa, Artificial Sequence
  Description of Artificial Sequence: Synthetic peptide
GGWLAGGELLN

SEQ ID NO: 515 - protein, 11 aa, Artificial Sequence
  Description of Artificial Sequence: Synthetic peptide
RTSQGINHYLN

SEQ ID NO: 516 - protein, 7 aa, Artificial Sequence
  Description of Artificial Sequence: Synthetic peptide
AASELQT

SEQ ID NO: 517 - protein, 9 aa, Artificial Sequence
  Description of Artificial Sequence: Synthetic peptide
QQTYTSPYT

SEQ ID NO: 518 - protein, 5 aa, Artificial Sequence
  Description of Artificial Sequence: Synthetic peptide
LYNMT

SEQ ID NO: 519 - protein, 17 aa, Artificial Sequence
  Description of Artificial Sequence: Synthetic peptide
YIYPSGGGTHYADSVKG

SEQ ID NO: 520 - protein, 12 aa, Artificial Sequence
  Description of Artificial Sequence: Synthetic peptide
DTGFWSADAFDI

SEQ ID NO: 521 - protein, 11 aa, Artificial Sequence
  Description of Artificial Sequence: Synthetic peptide
RASQTISVYVN

SEQ ID NO: 522 - protein, 7 aa, Artificial Sequence
  Description of Artificial Sequence: Synthetic peptide
GASSLQS

SEQ ID NO: 523 - protein, 9 aa, Artificial Sequence
  Description of Artificial Sequence: Synthetic peptide
QQSYSIPFT

SEQ ID NO: 524 - protein, 5 aa, Artificial Sequence
  Description of Artificial Sequence: Synthetic peptide
QYPMN

SEQ ID NO: 525 - protein, 17 aa, Artificial Sequence
  Description of Artificial Sequence: Synthetic peptide
SISSSGGFTTYADSVKG

SEQ ID NO: 526 - protein, 9 aa, Artificial Sequence
  Description of Artificial Sequence: Synthetic peptide
EEQQGGFDY

SEQ ID NO: 527 - protein, 11 aa, Artificial Sequence
  Description of Artificial Sequence: Synthetic peptide
RASQSISRYLN

SEQ ID NO: 528 - protein, 7 aa, Artificial Sequence
  Description of Artificial Sequence: Synthetic peptide
AASTLET

SEQ ID NO: 529 - protein, 9 aa, Artificial Sequence
  Description of Artificial Sequence: Synthetic peptide
QQSYSTPYT

SEQ ID NO: 530 - protein, 5 aa, Artificial Sequence
  Description of Artificial Sequence: Synthetic peptide
WYYMG

SEQ ID NO: 531 - protein, 17 aa, Artificial Sequence
  Description of Artificial Sequence: Synthetic peptide
WIVSSGGLTLYADSVKG

SEQ ID NO: 532 - protein, 11 aa, Artificial Sequence
  Description of Artificial Sequence: Synthetic peptide
TTVTTGDAFDI

SEQ ID NO: 533 - protein, 11 aa, Artificial Sequence
  Description of Artificial Sequence: Synthetic peptide
RASQGIRNDLG

SEQ ID NO: 534 - protein, 7 aa, Artificial Sequence
  Description of Artificial Sequence: Synthetic peptide
AASILQS

SEQ ID NO: 535 - protein, 9 aa, Artificial Sequence
  Description of Artificial Sequence: Synthetic peptide
LQDYEYPLT

SEQ ID NO: 536 - protein, 5 aa, Artificial Sequence
  Description of Artificial Sequence: Synthetic peptide
LYSMY

SEQ ID NO: 537 - protein, 17 aa, Artificial Sequence
  Description of Artificial Sequence: Synthetic peptide
RIRPSGGGTVYADSVKG

SEQ ID NO: 538 - protein, 9 aa, Artificial Sequence
  Description of Artificial Sequence: Synthetic peptide
DPLYSSGDV

SEQ ID NO: 539 - protein, 11 aa, Artificial Sequence
  Description of Artificial Sequence: Synthetic peptide
RASQSIGIYLN

SEQ ID NO: 540 - protein, 7 aa, Artificial Sequence
  Description of Artificial Sequence: Synthetic peptide
GASSLQS

SEQ ID NO: 541 - protein, 9 aa, Artificial Sequence
  Description of Artificial Sequence: Synthetic peptide
QHSYSTPFT

SEQ ID NO: 542 - protein, 5 aa, Artificial Sequence
  Description of Artificial Sequence: Synthetic peptide
SYAMV

SEQ ID NO: 543 - protein, 17 aa, Artificial Sequence
  Description of Artificial Sequence: Synthetic peptide
SIGSSGGFTLYADSVKG

SEQ ID NO: 544 - protein, 11 aa, Artificial Sequence
  Description of Artificial Sequence: Synthetic peptide
MNLGGGDAFDI

SEQ ID NO: 545 - protein, 11 aa, Artificial Sequence
  Description of Artificial Sequence: Synthetic peptide
SGDKLGEKYVS

SEQ ID NO: 546 - protein, 7 aa, Artificial Sequence
  Description of Artificial Sequence: Synthetic peptide
QDNKRPS

SEQ ID NO: 547 - protein, 9 aa, Artificial Sequence
  Description of Artificial Sequence: Synthetic peptide
QAWDSYTVV

SEQ ID NO: 548 - protein, 5 aa, Artificial Sequence
  Description of Artificial Sequence: Synthetic peptide
DYEMH

SEQ ID NO: 549 - protein, 17 aa, Artificial Sequence
  Description of Artificial Sequence: Synthetic peptide
GISPSGGKTQYADSVKG

SEQ ID NO: 550 - protein, 16 aa, Artificial Sequence
  Description of Artificial Sequence: Synthetic peptide
DLKWGGRGSPDWYFDL

SEQ ID NO: 551 - protein, 11 aa, Artificial Sequence
  Description of Artificial Sequence: Synthetic peptide
RASQSISSYLN

SEQ ID NO: 552 - protein, 7 aa, Artificial Sequence
  Description of Artificial Sequence: Synthetic peptide
AASSLQS

SEQ ID NO: 553 - protein, 9 aa, Artificial Sequence
  Description of Artificial Sequence: Synthetic peptide
QQSYSTPPT

SEQ ID NO: 554 - protein, 5 aa, Artificial Sequence
  Description of Artificial Sequence: Synthetic peptide
NYPMD

SEQ ID NO: 555 - protein, 17 aa, Artificial Sequence
  Description of Artificial Sequence: Synthetic peptide
SISSSGGWTNYADSVKG

SEQ ID NO: 556 - protein, 11 aa, Artificial Sequence
  Description of Artificial Sequence: Synthetic peptide
DTSGSYLGFDY

SEQ ID NO: 557 - protein, 11 aa, Artificial Sequence
  Description of Artificial Sequence: Synthetic peptide
RASQSISTYLN

SEQ ID NO: 558 - protein, 7 aa, Artificial Sequence
  Description of Artificial Sequence: Synthetic peptide
GAFSLQS

SEQ ID NO: 559 - protein, 9 aa, Artificial Sequence
  Description of Artificial Sequence: Synthetic peptide
QQSHSTPPT

SEQ ID NO: 560 - protein, 5 aa, Artificial Sequence
  Description of Artificial Sequence: Synthetic peptide
QYKML

SEQ ID NO: 561 - protein, 17 aa, Artificial Sequence
  Description of Artificial Sequence: Synthetic peptide
GIGPSGGLTAYADSVKG

SEQ ID NO: 562 - protein, 11 aa, Artificial Sequence
  Description of Artificial Sequence: Synthetic peptide
APWFGELGMDV

SEQ ID NO: 563 - protein, 11 aa, Artificial Sequence
  Description of Artificial Sequence: Synthetic peptide
RASQSISAYLN

SEQ ID NO: 564 - protein, 8 aa, Artificial Sequence
  Description of Artificial Sequence: Synthetic peptide
YGVGSLQS

SEQ ID NO: 565 - protein, 9 aa, Artificial Sequence
  Description of Artificial Sequence: Synthetic peptide
QQGYTTPVT

SEQ ID NO: 566 - protein, 5 aa, Artificial Sequence
  Description of Artificial Sequence: Synthetic peptide
WYRMD

SEQ ID NO: 567 - protein, 17 aa, Artificial Sequence
  Description of Artificial Sequence: Synthetic peptide
SIWPSGGLTSYADSVKG

SEQ ID NO: 568 - protein, 11 aa, Artificial Sequence
  Description of Artificial Sequence: Synthetic peptide
GWAPGGDAFDI

SEQ ID NO: 569 - protein, 11 aa, Artificial Sequence
  Description of Artificial Sequence: Synthetic peptide
RASQSISSYLN

SEQ ID NO: 570 - protein, 7 aa, Artificial Sequence
  Description of Artificial Sequence: Synthetic peptide
AASSLQS

SEQ ID NO: 571 - protein, 9 aa, Artificial Sequence
  Description of Artificial Sequence: Synthetic peptide
QQSYSTPYT

SEQ ID NO: 572 - protein, 5 aa, Artificial Sequence
  Description of Artificial Sequence: Synthetic peptide
DYTMW

SEQ ID NO: 573 - protein, 17 aa, Artificial Sequence
  Description of Artificial Sequence: Synthetic peptide
SISSSGGITFYADSVKG

SEQ ID NO: 574 - protein, 12 aa, Artificial Sequence
  Description of Artificial Sequence: Synthetic peptide
SADTAMGGAFDI

SEQ ID NO: 575 - protein, 11 aa, Artificial Sequence
  Description of Artificial Sequence: Synthetic peptide
SGDKLGDEYAA

SEQ ID NO: 576 - protein, 7 aa, Artificial Sequence
  Description of Artificial Sequence: Synthetic peptide
QDRKRPS

SEQ ID NO: 577 - protein, 9 aa, Artificial Sequence
  Description of Artificial Sequence: Synthetic peptide
QAWGKRNVV

SEQ ID NO: 578 - protein, 5 aa, Artificial Sequence
  Description of Artificial Sequence: Synthetic peptide
WYQMM

SEQ ID NO: 579 - protein, 17 aa, Artificial Sequence
  Description of Artificial Sequence: Synthetic peptide
SISPSGGITEYADSVKG

SEQ ID NO: 580 - protein, 13 aa, Artificial Sequence
  Description of Artificial Sequence: Synthetic peptide
DRSSGWYYYGMDV

SEQ ID NO: 581 - protein, 11 aa, Artificial Sequence
  Description of Artificial Sequence: Synthetic peptide
RASQSISSYLN

SEQ ID NO: 582 - protein, 7 aa, Artificial Sequence
  Description of Artificial Sequence: Synthetic peptide
AASSLQS

SEQ ID NO: 583 - protein, 9 aa, Artificial Sequence
  Description of Artificial Sequence: Synthetic peptide
QQSYSTPRT

SEQ ID NO: 584 - protein, 5 aa, Artificial Sequence
  Description of Artificial Sequence: Synthetic peptide
SYMMH

SEQ ID NO: 585 - protein, 17 aa, Artificial Sequence
  Description of Artificial Sequence: Synthetic peptide
GIYPSGGWTDYADSVKG

SEQ ID NO: 586 - protein, 10 aa, Artificial Sequence
  Description of Artificial Sequence: Synthetic peptide
LVAGLDAFDI

SEQ ID NO: 587 - protein, 11 aa, Artificial Sequence
  Description of Artificial Sequence: Synthetic peptide
RASQSISSYLN

SEQ ID NO: 588 - protein, 7 aa, Artificial Sequence
  Description of Artificial Sequence: Synthetic peptide
AASSLQS

SEQ ID NO: 589 - protein, 9 aa, Artificial Sequence
  Description of Artificial Sequence: Synthetic peptide
QQSYSTPPT

SEQ ID NO: 590 - protein, 5 aa, Artificial Sequence
  Description of Artificial Sequence: Synthetic peptide
WYPMT

SEQ ID NO: 591 - protein, 17 aa, Artificial Sequence
  Description of Artificial Sequence: Synthetic peptide
SIGPSGGQTIYADSVKG

SEQ ID NO: 592 - protein, 11 aa, Artificial Sequence
  Description of Artificial Sequence: Synthetic peptide
EYGDYGGGFDP

SEQ ID NO: 593 - protein, 11 aa, Artificial Sequence
  Description of Artificial Sequence: Synthetic peptide
RASQGISSYLA

SEQ ID NO: 594 - protein, 7 aa, Artificial Sequence
  Description of Artificial Sequence: Synthetic peptide
AASSLQS

SEQ ID NO: 595 - protein, 9 aa, Artificial Sequence
  Description of Artificial Sequence: Synthetic peptide
QQSYNTLRT

SEQ ID NO: 596 - protein, 5 aa, Artificial Sequence
  Description of Artificial Sequence: Synthetic peptide
SYHMM

SEQ ID NO: 597 - protein, 17 aa, Artificial Sequence
  Description of Artificial Sequence: Synthetic peptide
SIYPSGGATMYADSVKG

SEQ ID NO: 598 - protein, 13 aa, Artificial Sequence
  Description of Artificial Sequence: Synthetic peptide
DGYHYGDYTYFQH

SEQ ID NO: 599 - protein, 11 aa, Artificial Sequence
  Description of Artificial Sequence: Synthetic peptide
RASQSISTYLN

SEQ ID NO: 600 - protein, 7 aa, Artificial Sequence
  Description of Artificial Sequence: Synthetic peptide
GASSLQS

SEQ ID NO: 601 - protein, 9 aa, Artificial Sequence
  Description of Artificial Sequence: Synthetic peptide
QQSYSDPYT

SEQ ID NO: 602 - protein, 5 aa, Artificial Sequence
  Description of Artificial Sequence: Synthetic peptide
LYRMF

SEQ ID NO: 603 - protein, 17 aa, Artificial Sequence
  Description of Artificial Sequence: Synthetic peptide
SIWSSGGPTMYADSVKG

SEQ ID NO: 604 - protein, 10 aa, Artificial Sequence
  Description of Artificial Sequence: Synthetic peptide
EYPSTYYFDY

SEQ ID NO: 605 - protein, 11 aa, Artificial Sequence
  Description of Artificial Sequence: Synthetic peptide
RASQRISYYLT

SEQ ID NO: 606 - protein, 7 aa, Artificial Sequence
  Description of Artificial Sequence: Synthetic peptide
AASSLES

SEQ ID NO: 607 - protein, 9 aa, Artificial Sequence
  Description of Artificial Sequence: Synthetic peptide
QQAFSTPFT

SEQ ID NO: 608 - protein, 5 aa, Artificial Sequence
  Description of Artificial Sequence: Synthetic peptide
AYYMV

SEQ ID NO: 609 - protein, 17 aa, Artificial Sequence
  Description of Artificial Sequence: Synthetic peptide
YISPSGGQTQYADSVKG

SEQ ID NO: 610 - protein, 10 aa, Artificial Sequence
  Description of Artificial Sequence: Synthetic peptide
EAISSSSFDY

SEQ ID NO: 611 - protein, 11 aa, Artificial Sequence
  Description of Artificial Sequence: Synthetic peptide
RTRQSISNYLN

SEQ ID NO: 612 - protein, 7 aa, Artificial Sequence
  Description of Artificial Sequence: Synthetic peptide
AASSLQS

SEQ ID NO: 613 - protein, 9 aa, Artificial Sequence
  Description of Artificial Sequence: Synthetic peptide
QQSYDIPFT

SEQ ID NO: 614 - protein, 5 aa, Artificial Sequence
  Description of Artificial Sequence: Synthetic peptide
EYDMA

SEQ ID NO: 615 - protein, 17 aa, Artificial Sequence
  Description of Artificial Sequence: Synthetic peptide
YIVSSGGFTSYADSVKG

SEQ ID NO: 616 - protein, 10 aa, Artificial Sequence
  Description of Artificial Sequence: Synthetic peptide
WAGWIAAADY

SEQ ID NO: 617 - protein, 11 aa, Artificial Sequence
  Description of Artificial Sequence: Synthetic peptide
RASQSISNYLN

SEQ ID NO: 618 - protein, 7 aa, Artificial Sequence
  Description of Artificial Sequence: Synthetic peptide
AASSLQS

SEQ ID NO: 619 - protein, 9 aa, Artificial Sequence
  Description of Artificial Sequence: Synthetic peptide
QQSYSTPQT

SEQ ID NO: 620 - protein, 5 aa, Artificial Sequence
  Description of Artificial Sequence: Synthetic peptide
AYQMA

SEQ ID NO: 621 - protein, 17 aa, Artificial Sequence
  Description of Artificial Sequence: Synthetic peptide
VIYSSGGYTDYADSVKG

SEQ ID NO: 622 - protein, 10 aa, Artificial Sequence
  Description of Artificial Sequence: Synthetic peptide
HNWNDGAFDI

SEQ ID NO: 623 - protein, 11 aa, Artificial Sequence
  Description of Artificial Sequence: Synthetic peptide
RASQSISSYLN

SEQ ID NO: 624 - protein, 7 aa, Artificial Sequence
  Description of Artificial Sequence: Synthetic peptide
AASSLQS

SEQ ID NO: 625 - protein, 8 aa, Artificial Sequence
  Description of Artificial Sequence: Synthetic peptide
QQSYSTLT

SEQ ID NO: 626 - protein, 5 aa, Artificial Sequence
  Description of Artificial Sequence: Synthetic peptide
WYAMH

SEQ ID NO: 627 - protein, 17 aa, Artificial Sequence
  Description of Artificial Sequence: Synthetic peptide
GIYSSGGYTKYADSVKG

SEQ ID NO: 628 - protein, 11 aa, Artificial Sequence
  Description of Artificial Sequence: Synthetic peptide
DLSNGDDVFDI

SEQ ID NO: 629 - protein, 11 aa, Artificial Sequence
  Description of Artificial Sequence: Synthetic peptide
RASQSINFYLN

SEQ ID NO: 630 - protein, 7 aa, Artificial Sequence
  Description of Artificial Sequence: Synthetic peptide
VASSLES

SEQ ID NO: 631 - protein, 9 aa, Artificial Sequence
  Description of Artificial Sequence: Synthetic peptide
LQSYSAPYT

SEQ ID NO: 632 - protein, 5 aa, Artificial Sequence
  Description of Artificial Sequence: Synthetic peptide
YYQMG

SEQ ID NO: 633 - protein, 17 aa, Artificial Sequence
  Description of Artificial Sequence: Synthetic peptide
SIYPSGGMTDYADSVKG

SEQ ID NO: 634 - protein, 11 aa, Artificial Sequence
  Description of Artificial Sequence: Synthetic peptide
GSPWGDDAFDI

SEQ ID NO: 635 - protein, 11 aa, Artificial Sequence
  Description of Artificial Sequence: Synthetic peptide
RTSRRIGTYLN

SEQ ID NO: 636 - protein, 7 aa, Artificial Sequence
  Description of Artificial Sequence: Synthetic peptide
GASSLQS

SEQ ID NO: 637 - protein, 9 aa, Artificial Sequence
  Description of Artificial Sequence: Synthetic peptide
QQSFSSPWT

SEQ ID NO: 638 - protein, 5 aa, Artificial Sequence
  Description of Artificial Sequence: Synthetic peptide
WYPMQ

SEQ ID NO: 639 - protein, 17 aa, Artificial Sequence
  Description of Artificial Sequence: Synthetic peptide
YIYPSGGGTDYADSVKG

SEQ ID NO: 640 - protein, 11 aa, Artificial Sequence
  Description of Artificial Sequence: Synthetic peptide
SSGWLGDAFDI

SEQ ID NO: 641 - protein, 11 aa, Artificial Sequence
  Description of Artificial Sequence: Synthetic peptide
RASQSIATYLN

SEQ ID NO: 642 - protein, 7 aa, Artificial Sequence
  Description of Artificial Sequence: Synthetic peptide
AASSLQS

SEQ ID NO: 643 - protein, 9 aa, Artificial Sequence
  Description of Artificial Sequence: Synthetic peptide
QQSYSTRET

SEQ ID NO: 644 - protein, 5 aa, Artificial Sequence
  Description of Artificial Sequence: Synthetic peptide
WYTMH

SEQ ID NO: 645 - protein, 17 aa, Artificial Sequence
  Description of Artificial Sequence: Synthetic peptide
VIYPSGGPTSYADSVKG

SEQ ID NO: 646 - protein, 11 aa, Artificial Sequence
  Description of Artificial Sequence: Synthetic peptide
DGSGSYLGFDY

SEQ ID NO: 647 - protein, 11 aa, Artificial Sequence
  Description of Artificial Sequence: Synthetic peptide
RASQSISSYLN

SEQ ID NO: 648 - protein, 7 aa, Artificial Sequence
  Description of Artificial Sequence: Synthetic peptide
AASSLQS

SEQ ID NO: 649 - protein, 9 aa, Artificial Sequence
  Description of Artificial Sequence: Synthetic peptide
QQTYTTPWT

SEQ ID NO: 650 - protein, 5 aa, Artificial Sequence
  Description of Artificial Sequence: Synthetic peptide
SYPMG

SEQ ID NO: 651 - protein, 17 aa, Artificial Sequence
  Description of Artificial Sequence: Synthetic peptide
RISSSGGMTIYADSVKG

SEQ ID NO: 652 - protein, 9 aa, Artificial Sequence
  Description of Artificial Sequence: Synthetic peptide
DDWNVGMDV

SEQ ID NO: 653 - protein, 11 aa, Artificial Sequence
  Description of Artificial Sequence: Synthetic peptide
RASQDISNWLA

SEQ ID NO: 654 - protein, 7 aa, Artificial Sequence
  Description of Artificial Sequence: Synthetic peptide
AASSLQT

SEQ ID NO: 655 - protein, 9 aa, Artificial Sequence
  Description of Artificial Sequence: Synthetic peptide
QQSYSLPWT

SEQ ID NO: 656 - protein, 5 aa, Artificial Sequence
  Description of Artificial Sequence: Synthetic peptide
LYDMT

SEQ ID NO: 657 - protein, 17 aa, Artificial Sequence
  Description of Artificial Sequence: Synthetic peptide
GISSSGGVTIYADSVKG

SEQ ID NO: 658 - protein, 15 aa, Artificial Sequence
  Description of Artificial Sequence: Synthetic peptide
TYYYDSSGYADAFDI

SEQ ID NO: 659 - protein, 11 aa, Artificial Sequence
  Description of Artificial Sequence: Synthetic peptide
RASQSINTYLN

SEQ ID NO: 660 - protein, 7 aa, Artificial Sequence
  Description of Artificial Sequence: Synthetic peptide
AASTLES

SEQ ID NO: 661 - protein, 9 aa, Artificial Sequence
  Description of Artificial Sequence: Synthetic peptide
QQSYSTPPT

SEQ ID NO: 662 - protein, 5 aa, Artificial Sequence
  Description of Artificial Sequence: Synthetic peptide
VYLMH

SEQ ID NO: 663 - protein, 17 aa, Artificial Sequence
  Description of Artificial Sequence: Synthetic peptide
GISPSGGYTQYADSVKG

SEQ ID NO: 664 - protein, 9 aa, Artificial Sequence
  Description of Artificial Sequence: Synthetic peptide
PGGLDAFDI

SEQ ID NO: 665 - protein, 11 aa, Artificial Sequence
  Description of Artificial Sequence: Synthetic peptide
RASQSISSYLN

SEQ ID NO: 666 - protein, 7 aa, Artificial Sequence
  Description of Artificial Sequence: Synthetic peptide
AASSLQS

SEQ ID NO: 667 - protein, 9 aa, Artificial Sequence
  Description of Artificial Sequence: Synthetic peptide
QQSYSTPLT

SEQ ID NO: 668 - protein, 5 aa, Artificial Sequence
  Description of Artificial Sequence: Synthetic peptide
RYIMW

SEQ ID NO: 669 - protein, 17 aa, Artificial Sequence
  Description of Artificial Sequence: Synthetic peptide
GIYSSGGYTQYADSVKG

SEQ ID NO: 670 - protein, 10 aa, Artificial Sequence
  Description of Artificial Sequence: Synthetic peptide
ELEGLGGFDY

SEQ ID NO: 671 - protein, 11 aa, Artificial Sequence
  Description of Artificial Sequence: Synthetic peptide
RASQGISSWLA

SEQ ID NO: 672 - protein, 7 aa, Artificial Sequence
  Description of Artificial Sequence: Synthetic peptide
ATSGLQS

SEQ ID NO: 673 - protein, 9 aa, Artificial Sequence
  Description of Artificial Sequence: Synthetic peptide
QQAKSFPLT

SEQ ID NO: 674 - protein, 5 aa, Artificial Sequence
  Description of Artificial Sequence: Synthetic peptide
DYTMY

SEQ ID NO: 675 - protein, 17 aa, Artificial Sequence
  Description of Artificial Sequence: Synthetic peptide
SIVPSGGHTLYADSVKG

SEQ ID NO: 676 - protein, 13 aa, Artificial Sequence
  Description of Artificial Sequence: Synthetic peptide
DHLSSWYGGFFDY

SEQ ID NO: 677 - protein, 11 aa, Artificial Sequence
  Description of Artificial Sequence: Synthetic peptide
RASQSISSYLN

SEQ ID NO: 678 - protein, 7 aa, Artificial Sequence
  Description of Artificial Sequence: Synthetic peptide
AASSLQS

SEQ ID NO: 679 - protein, 9 aa, Artificial Sequence
  Description of Artificial Sequence: Synthetic peptide
QQSYSTRYT

SEQ ID NO: 680 - protein, 5 aa, Artificial Sequence
  Description of Artificial Sequence: Synthetic peptide
GYDMM

SEQ ID NO: 681 - protein, 17 aa, Artificial Sequence
  Description of Artificial Sequence: Synthetic peptide
VISSSGGNTAYADSVKG

SEQ ID NO: 682 - protein, 10 aa, Artificial Sequence
  Description of Artificial Sequence: Synthetic peptide
ESSGLYYFDY

SEQ ID NO: 683 - protein, 11 aa, Artificial Sequence
  Description of Artificial Sequence: Synthetic peptide
RASQSITIYLN

SEQ ID NO: 684 - protein, 7 aa, Artificial Sequence
  Description of Artificial Sequence: Synthetic peptide
GASNLHS

SEQ ID NO: 685 - protein, 9 aa, Artificial Sequence
  Description of Artificial Sequence: Synthetic peptide
QQSYDTPLT

SEQ ID NO: 686 - protein, 5 aa, Artificial Sequence
  Description of Artificial Sequence: Synthetic peptide
WYPMY

SEQ ID NO: 687 - protein, 17 aa, Artificial Sequence
  Description of Artificial Sequence: Synthetic peptide
SIGSSGGPTPYADSVKG

SEQ ID NO: 688 - protein, 10 aa, Artificial Sequence
  Description of Artificial Sequence: Synthetic peptide
WADYGGSLDY

SEQ ID NO: 689 - protein, 13 aa, Artificial Sequence
  Description of Artificial Sequence: Synthetic peptide
SGSSSNIGNNAVS

SEQ ID NO: 690 - protein, 7 aa, Artificial Sequence
  Description of Artificial Sequence: Synthetic peptide
YDDLLPS

SEQ ID NO: 691 - protein, 11 aa, Artificial Sequence
  Description of Artificial Sequence: Synthetic peptide
AAWDDSLNGFV

SEQ ID NO: 692 - protein, 5 aa, Artificial Sequence
  Description of Artificial Sequence: Synthetic peptide
RYPMM

SEQ ID NO: 693 - protein, 17 aa, Artificial Sequence
  Description of Artificial Sequence: Synthetic peptide
VIYPSGGDTFYADSVKG

SEQ ID NO: 694 - protein, 11 aa, Artificial Sequence
  Description of Artificial Sequence: Synthetic peptide
GDDYLWEAAVY

SEQ ID NO: 695 - protein, 11 aa, Artificial Sequence
  Description of Artificial Sequence: Synthetic peptide
RASQNIGNDVA

SEQ ID NO: 696 - protein, 7 aa, Artificial Sequence
  Description of Artificial Sequence: Synthetic peptide
HASTRAY

SEQ ID NO: 697 - protein, 10 aa, Artificial Sequence
  Description of Artificial Sequence: Synthetic peptide
QQFYDWPAHT

SEQ ID NO: 698 - protein, 5 aa, Artificial Sequence
  Description of Artificial Sequence: Synthetic peptide
YYHMW

SEQ ID NO: 699 - protein, 17 aa, Artificial Sequence
  Description of Artificial Sequence: Synthetic peptide
GISPSGGFTFYADSVKG

SEQ ID NO: 700 - protein, 14 aa, Artificial Sequence
  Description of Artificial Sequence: Synthetic peptide
DYYYDSSGYSPLGY

SEQ ID NO: 701 - protein, 11 aa, Artificial Sequence
  Description of Artificial Sequence: Synthetic peptide
RASQSISIYLN

SEQ ID NO: 702 - protein, 7 aa, Artificial Sequence
  Description of Artificial Sequence: Synthetic peptide
GASQLES

SEQ ID NO: 703 - protein, 9 aa, Artificial Sequence
  Description of Artificial Sequence: Synthetic peptide
QQSYNVPYT

SEQ ID NO: 704 - protein, 5 aa, Artificial Sequence
  Description of Artificial Sequence: Synthetic peptide
FYKMI

SEQ ID NO: 705 - protein, 17 aa, Artificial Sequence
  Description of Artificial Sequence: Synthetic peptide
SISSSGGSTQYADSVKG

SEQ ID NO: 706 - protein, 10 aa, Artificial Sequence
  Description of Artificial Sequence: Synthetic peptide
DRVDLGYLDY

SEQ ID NO: 707 - protein, 11 aa, Artificial Sequence
  Description of Artificial Sequence: Synthetic peptide
RTSQNINTYLN

SEQ ID NO: 708 - protein, 7 aa, Artificial Sequence
  Description of Artificial Sequence: Synthetic peptide
GVSSLHR

SEQ ID NO: 709 - protein, 9 aa, Artificial Sequence
  Description of Artificial Sequence: Synthetic peptide
QQSYSSPWT

SEQ ID NO: 710 - protein, 5 aa, Artificial Sequence
  Description of Artificial Sequence: Synthetic peptide
QYLMM

SEQ ID NO: 711 - protein, 17 aa, Artificial Sequence
  Description of Artificial Sequence: Synthetic peptide
SIYPSGGYTSYADSVKG

SEQ ID NO: 712 - protein, 10 aa, Artificial Sequence
  Description of Artificial Sequence: Synthetic peptide
VSTAVADNDY

SEQ ID NO: 713 - protein, 11 aa, Artificial Sequence
  Description of Artificial Sequence: Synthetic peptide
RASQTIDNYLH

SEQ ID NO: 714 - protein, 7 aa, Artificial Sequence
  Description of Artificial Sequence: Synthetic peptide
DASSLQS

SEQ ID NO: 715 - protein, 10 aa, Artificial Sequence
  Description of Artificial Sequence: Synthetic peptide
QQSYDTPQYT

SEQ ID NO: 716 - protein, 5 aa, Artificial Sequence
  Description of Artificial Sequence: Synthetic peptide
LYDMN

SEQ ID NO: 717 - protein, 17 aa, Artificial Sequence
  Description of Artificial Sequence: Synthetic peptide
GISPSGGQTMYADSVKG

SEQ ID NO: 718 - protein, 9 aa, Artificial Sequence
  Description of Artificial Sequence: Synthetic peptide
QPMISAFDI

SEQ ID NO: 719 - protein, 11 aa, Artificial Sequence
  Description of Artificial Sequence: Synthetic peptide
RASQSISSYLN

SEQ ID NO: 720 - protein, 7 aa, Artificial Sequence
  Description of Artificial Sequence: Synthetic peptide
AASSLQS

SEQ ID NO: 721 - protein, 10 aa, Artificial Sequence
  Description of Artificial Sequence: Synthetic peptide
QQSYSTPPWT

SEQ ID NO: 722 - protein, 5 aa, Artificial Sequence
  Description of Artificial Sequence: Synthetic peptide
LYAMW

SEQ ID NO: 723 - protein, 17 aa, Artificial Sequence
  Description of Artificial Sequence: Synthetic peptide
YISSSGGFTSYADSVKG

SEQ ID NO: 724 - protein, 10 aa, Artificial Sequence
  Description of Artificial Sequence: Synthetic peptide
YRVGVAATDY

SEQ ID NO: 725 - protein, 11 aa, Artificial Sequence
  Description of Artificial Sequence: Synthetic peptide
RASQSISTYLN

SEQ ID NO: 726 - protein, 7 aa, Artificial Sequence
  Description of Artificial Sequence: Synthetic peptide
AASSLQS

SEQ ID NO: 727 - protein, 9 aa, Artificial Sequence
  Description of Artificial Sequence: Synthetic peptide
QQSYSTPHT

SEQ ID NO: 728 - protein, 5 aa, Artificial Sequence
  Description of Artificial Sequence: Synthetic peptide
GYIMH

SEQ ID NO: 729 - protein, 17 aa, Artificial Sequence
  Description of Artificial Sequence: Synthetic peptide
WIYPSGGWTEYADSVKG

SEQ ID NO: 730 - protein, 10 aa, Artificial Sequence
  Description of Artificial Sequence: Synthetic peptide
DAPGVGAIDY

SEQ ID NO: 731 - protein, 11 aa, Artificial Sequence
  Description of Artificial Sequence: Synthetic peptide
RASQDISVYLN

SEQ ID NO: 732 - protein, 7 aa, Artificial Sequence
  Description of Artificial Sequence: Synthetic peptide
GGASLQS

SEQ ID NO: 733 - protein, 9 aa, Artificial Sequence
  Description of Artificial Sequence: Synthetic peptide
QQSYSLPFT

SEQ ID NO: 734 - protein, 5 aa, Artificial Sequence
  Description of Artificial Sequence: Synthetic peptide
MYWMQ

SEQ ID NO: 735 - protein, 17 aa, Artificial Sequence
  Description of Artificial Sequence: Synthetic peptide
YIYPSGGPTKYADSVKG

SEQ ID NO: 736 - protein, 11 aa, Artificial Sequence
  Description of Artificial Sequence: Synthetic peptide
PSGSYGDAFDI

SEQ ID NO: 737 - protein, 11 aa, Artificial Sequence
  Description of Artificial Sequence: Synthetic peptide
RASQNISSYLN

SEQ ID NO: 738 - protein, 7 aa, Artificial Sequence
  Description of Artificial Sequence: Synthetic peptide
AASSLQS

SEQ ID NO: 739 - protein, 9 aa, Artificial Sequence
  Description of Artificial Sequence: Synthetic peptide
QQSYSTPRT

SEQ ID NO: 740 - protein, 5 aa, Artificial Sequence
  Description of Artificial Sequence: Synthetic peptide
LYIMG

SEQ ID NO: 741 - protein, 17 aa, Artificial Sequence
  Description of Artificial Sequence: Synthetic peptide
GIYPSGGFTMYADSVKG

SEQ ID NO: 742 - protein, 10 aa, Artificial Sequence
  Description of Artificial Sequence: Synthetic peptide
ESSGVAAPDY

SEQ ID NO: 743 - protein, 16 aa, Artificial Sequence
  Description of Artificial Sequence: Synthetic peptide
RSSQSLLHSRGYNYLD

SEQ ID NO: 744 - protein, 7 aa, Artificial Sequence
  Description of Artificial Sequence: Synthetic peptide
LGSNRAS

SEQ ID NO: 745 - protein, 8 aa, Artificial Sequence
  Description of Artificial Sequence: Synthetic peptide
MQALQRRT

SEQ ID NO: 746 - protein, 5 aa, Artificial Sequence
  Description of Artificial Sequence: Synthetic peptide
YYTMI

SEQ ID NO: 747 - protein, 17 aa, Artificial Sequence
  Description of Artificial Sequence: Synthetic peptide
GIRSSGGGTRYADSVKG

SEQ ID NO: 748 - protein, 18 aa, Artificial Sequence
  Description of Artificial Sequence: Synthetic peptide
DGSRYSYGSIYYYYGMDA

SEQ ID NO: 749 - protein, 109 aa, Artificial Sequence
  Description of Artificial Sequence: Synthetic polypeptide
QDIQMTQSPSSLSASVGDSVTISCRASQSISMYLNWYQHKPGKAPKLLIYGTSSLQSGVPSRFSGSGPGGTDFTLTISSLQPEDFATYYCQQSYSAPWTFGQGTKVEIK

SEQ ID NO: 750 - protein, 136 aa, Artificial Sequence
  Description of Artificial Sequence: Synthetic polypeptide
EVQLLESGGGLVQPGGSLRLSCAASGFTFSLYQMTWVRQAPGKGLEWVSGIWPSGGFTDYADSVKGRFTISRDNSKNTLYLQMNSLRAEDTAVYYCARVSTAVADNDYWGQGTLVTVSSASTKGPSVFPLAPSSKS

SEQ ID NO: 751 - protein, 108 aa, Artificial Sequence
  Description of Artificial Sequence: Synthetic polypeptide
QDIQMTQSPSSLSASVGDRVTITCRASQRISFYLNWFQQKPGKAPNLLIYGASSLQSGVPSRFSGSGSGTDFTLTISSLQPKDFGTYYCQQTFSTPNTFGQGTKLEIK

SEQ ID NO: 752 - protein, 138 aa, Artificial Sequence
  Description of Artificial Sequence: Synthetic polypeptide
EVQLLESGGGLVQPGGSLRLSCAASGFTFSPYPMQWVRQAPGKGLEWVSSISSSGGMTEYADSVKGRFTISRDNSKNTLYLQMNSLRAEDTAVYYCARDDYGGKGGAFDIWGQGTMVTVSSASTKGPSVFPLAPSSKS

SEQ ID NO: 753 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTLWTFGQGTKVEIK

SEQ ID NO: 754 - protein, 136 aa, Artificial Sequence
  Description of Artificial Sequence: Synthetic polypeptide
EVQLLESGGGLVQPGGSLRLSCAASGFTFSKYFMGWVRQAPGKGLEWVSVIGSSGGWTSYADSVKGRFTISRDNSKNTLYLQMNSLRAEDTAVYYCARVSTAVADNDYWGQGTLVTVSSASTKGPSVFPLAPSSKS

SEQ ID NO: 755 - protein, 107 aa, Artificial Sequence
  Description of Artificial Sequence: Synthetic polypeptide
QDIQMTQSPSSLSASVGDRVTITCRASQSISSYLNWYQQKPGKAPKLLIYGASSLQSGVPSRFSGSGSGTDFTLTISSLQPEDSATYYCQQSYTRWTFGQGTKVEIK

SEQ ID NO: 756 - protein, 137 aa, Artificial Sequence
  Description of Artificial Sequence: Synthetic polypeptide
EVQLLESGGGLVQPGGSLRLSCAASGFTFSRYHMVWVRQAPGKGLEWVSSISPSGGWTNYADSVKGRFTISRDNSKNTLYLQMNSLRAEDTAMYYCAREMATIAGQFDPWGQGTLVTVSSASTKGPSVFPLAPSSKS

SEQ ID NO: 757 - protein, 108 aa, Artificial Sequence
  Description of Artificial Sequence: Synthetic polypeptide
QDIQMTQSPSSLSASVGDRVTITCRASQSISTYLNWYQLKPGKAPKLLIYNAFSMERGVPSTISGSGSGTDFTLTISSLQPEDFATYYCQQSYTTPTTFGQGTKVEIK

SEQ ID NO: 758 - protein, 137 aa, Artificial Sequence
  Description of Artificial Sequence: Synthetic polypeptide
EVQLLESGGGLVQPGGSLRLSCAASGFTFSRYRMVWVRQAPGKGLEWVSSIYPSGGMTAYADSVKGRFTISRDNSKNTLYLQMNSLRAEDTAVYYCARDAVGIGDAFDIWGQGTMVTVSSASTKGPSVFPLAPSSKS

SEQ ID NO: 759 - protein, 105 aa, Artificial Sequence
  Description of Artificial Sequence: Synthetic polypeptide
QSALTQPPSVSVSPGQTASITCSGDKLGDKYTSWHQQKPGQSPVLVIYQDSKRPSGIPERFSGSNSGNTATLTISGTQAMDEADYYCQAWDSSTVFGGGTRLTVL

SEQ ID NO: 760 - protein, 138 aa, Artificial Sequence
  Description of Artificial Sequence: Synthetic polypeptide
EVQLLESGGGLVQPGGSLRLSCAASGFTFSYYPMQWVRQAPGKGLEWVSYIYPSGGLTSYADSVKGRFTISRDNSKNTLYLQMNSLRAEDTAVYYCARLFYGSGSVGFEYWGQGTLVTVSSASTKGPSVFPLAPSSKS

SEQ ID NO: 761 - protein, 108 aa, Artificial Sequence
  Description of Artificial Sequence: Synthetic polypeptide
QDIQMTQSPSFVSASVGDRVTITCRASQDISSWLVWYQQKPGKGPKLLIYDASNLQSGVPSRFSGGGSGTHFTLTISSLQPEDFATYYCQQADGFPLTFGGGTKVEMK

SEQ ID NO: 762 - protein, 135 aa, Artificial Sequence
  Description of Artificial Sequence: Synthetic polypeptide
EVQLLESGGGLVQPGGSLRLSCAASGFTFSLYNMNWVRQAPGKGLEWVSSISPSGGFTDYADSVKGRFTISRDNSKNTLYLQMNSLRAEDTAVYYCARDLDLGILDYWGQGTLVTVSSASTKGPSVFPLAPSSKS

SEQ ID NO: 763 - protein, 109 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTLMYTFGQGTKLEIK

SEQ ID NO: 764 - protein, 136 aa, Artificial Sequence
  Description of Artificial Sequence: Synthetic polypeptide
EVQLLESGGGLVQPGGSLRLSCAASGFTFSHYFMTWVRQAPGKGLEWVSSIVPSGGMTQYADSVKGRFTISRDNSKNTLYLQMNSLRAEDTAVYYCARDSYSSSWFDIWGQGTMVTVSSASTKGPSVFPLAPSSKS

SEQ ID NO: 765 - protein, 108 aa, Artificial Sequence
  Description of Artificial Sequence: Synthetic polypeptide
QDIQMTQSPSSLSASVGDTVTITCRASQGVSYYLAWFQQKPGKAPKSLIYGASSLQSGVPSKFSGSGSGTVFTLTISSLQPDDFATYYCQQYNTYPPTFGQGTRLDIK

SEQ ID NO: 766 - protein, 136 aa, Artificial Sequence
  Description of Artificial Sequence: Synthetic polypeptide
EVQLLESGGGLVQPGGSLRLSCAASGFTFSLYEMLWVRQAPGKGLEWVSVIYPSGGYTDYADSVKGRFTISRDNSKNTLYLQMNSLRAEDMAVYYCARSFSGFGEIDYWGQGTLVTVSSASTKGPSVFPLAPSSKS

SEQ ID NO: 767 - protein, 108 aa, Artificial Sequence
  Description of Artificial Sequence: Synthetic polypeptide
QDIQMTQSPSSLSASIGDRVTITCRASQYISTYLNWYEQKPGKAPKLLIYGTSSLQSGVPSRFSGSGSGTEFSLTISSLQPEDFATYYCQQSFTTPFTFGQGTKLEIK

SEQ ID NO: 768 - protein, 138 aa, Artificial Sequence
  Description of Artificial Sequence: Synthetic polypeptide
EVQLLESGGGLVQPGGSLRLSCAASGFTFSGYWMGWVRQAPGKGLEWVSSISSSGGWTQYADSVKGRFTISRDNSKNTLYLQMNSLRAEDTATYYCARDDEIAAGGAFDIWGQGAMVTVSSASTKGPSVFPLAPSSKS

SEQ ID NO: 769 - protein, 107 aa, Artificial Sequence
  Description of Artificial Sequence: Synthetic polypeptide
QDIQMTQSPSSLSASLGDRVTITCRASQNIDIYLNWYQQTPGKAPKLLIYGAYNLQSGVPSRFSGSGSGTDFTLTISSLQPEDFGTYYCQQSYGTPVFGQGTKLEIK

SEQ ID NO: 770 - protein, 136 aa, Artificial Sequence
  Description of Artificial Sequence: Synthetic polypeptide
EVQLLESGGGLVQPGGSLRLSCAASGFTFSGYFMMWVRQAPGKGLEWVSSIYSSGGYTDYADSVKGRFTISRDNSKNTLYLQMNSLRAEDTAVYYCAREVAGTYAFDIWGQGTMVTVSSASTKGPSVFPLAPSSKS

SEQ ID NO: 771 - protein, 108 aa, Artificial Sequence
  Description of Artificial Sequence: Synthetic polypeptide
QDIQMTQSPSSLSASVGDRVTVTCRASQRISTYLNWYQQKPGKAPKLLISGASSLQSGVPSRFSGSGSGTDFTLTISSLQPDDFATYYCQQSYNTPRTFGQGTKVEIR

SEQ ID NO: 772 - protein, 137 aa, Artificial Sequence
  Description of Artificial Sequence: Synthetic polypeptide
EVQLLESGGGLVQPGGSLRLSCAASGFTFSAYEMWWVRQAPGKGLEWVSYIGSSGGSTSYADSVKGRFTISRDNSKNTLYLQMNSLRAEDTAVYYCTGGNSSSFDAFDIWGQGTMVTVSSASTKGPSVFPLAPSSKS

SEQ ID NO: 773 - protein, 108 aa, Artificial Sequence
  Description of Artificial Sequence: Synthetic polypeptide
QDIQMTQSPSSLSASVGDRVTITCRASQSISIYVNWYQQKPGKAPNLLIFAASSLQRGVPSRFSGSGSGADFTLTISSLQPEDFATYYCQQSFSTPLTFGGGTKVEIK

SEQ ID NO: 774 - protein, 136 aa, Artificial Sequence
  Description of Artificial Sequence: Synthetic polypeptide
EVQLLESGGGLVQPGGSLRLSCAASGFTFSHYGMVWVRQAPGKGLEWVSYIVPSGGLTYYADSVKGRFTISRDNSKNTLYLQMNSLRAEDTAVYYCARVDYTGDGLGYWGQGTLVTVSSASTKGPSVFPLAPSSKS

SEQ ID NO: 775 - protein, 108 aa, Artificial Sequence
  Description of Artificial Sequence: Synthetic polypeptide
QDIQMTQSPSSLSASVGDRVTITCRASQGISSYLNWYQQKPGNAPNLLIYGASSLQSGVPSRFSGSGSGTDFTLTISSLQPEDFATYYCQESYSTLFTFGPGTTVEIK

SEQ ID NO: 776 - protein, 137 aa, Artificial Sequence
  Description of Artificial Sequence: Synthetic polypeptide
EVQLLESGGGLVQPGGSLRLSCAASGFTFSLYPMQWVRQAPGKGLEWVSSIGSSGGMTFYADSVKGRFTISRDNSKNTLYLQMNSLRAEDTAVYYCTREVGAAGFAFDIWGQGTMVTVSSASTKGPSVFPLAPSSKS

SEQ ID NO: 777 - protein, 108 aa, Artificial Sequence
  Description of Artificial Sequence: Synthetic polypeptide
QDIQMTQSPSSLSASVGDRVTLTCRASRTISFYLNWYQQKAGKAPELLIYGGSSLHSGVPSRFSGSGSGTDFSLTISNLQPEDIAVYYCQQSFSSPWTFGQGTKVEIK

SEQ ID NO: 778 - protein, 137 aa, Artificial Sequence
  Description of Artificial Sequence: Synthetic polypeptide
EVQLLESGGGLVQPGGSLRLSCAASGFTFSWYKMMWVRQAPGKGLEWVSSIYPSGGWTNYADSVKGRFTISRDNSKNTLYLQMNSLRAEDTAVYYCTRGSPWGDDAFDIWGQGTMVTVSSASTKGPSVFPLAPSSKS

SEQ ID NO: 779 - protein, 108 aa, Artificial Sequence
  Description of Artificial Sequence: Synthetic polypeptide
QDIQMIQSPSSLSASVGDRVTITCRASQSISGYLNWYQQRSGKAPKLLIFAASNLQTGVPSRFSGSGSGTDFTLTINNLQPEDFATYYCQQSHTPPKTFGPGTKVDIK

SEQ ID NO: 780 - protein, 136 aa, Artificial Sequence
  Description of Artificial Sequence: Synthetic polypeptide
EVQLLESGGGLVQPGGSLRLSCAASGFTFSEYDMMWVRQAPGKGLEWVSSIGSSGGMTYYADSVKGRFTISRDNSKNTLYLQMNSLRAEDTAVYYCARDQVAAAAIDYWGQGTLVTVSSASTKGPSVFPLAPSSKS

SEQ ID NO: 781 - protein, 109 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPYTFGQGTKLEIK

SEQ ID NO: 782 - protein, 137 aa, Artificial Sequence
  Description of Artificial Sequence: Synthetic polypeptide
EVQLLESGGGLVQPGGSLRLSCAASGFTFSPYAMTWVRQAPGKGLEWVSVIYPSGGFTDYADSVKGRFTISRDNSKNTLYLQMNSLRAEDTAMYYCARASGSYLDAFDIWGQGTMVTVSSASTKGPSVFPLAPSSKS

SEQ ID NO: 783 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSKFSGSGSGTDYTLTISSLQPEDFATYYCQQTYTTPWTFGQGTKVEIK

SEQ ID NO: 784 - protein, 135 aa, Artificial Sequence
  Description of Artificial Sequence: Synthetic polypeptide
EVQLLESGGGLVQPGGSLRLSCAASGFTFSSYPMGWVRQAPGKGLEWVSRISSSGGMTIYADSVKGRFTISRDNSKNTLYLQMNSLRAEDTAVYYCARDDWNVGMDVWGQGTTVTVSSASTKGPSVFPLAPSSKS

SEQ ID NO: 785 - protein, 108 aa, Artificial Sequence
  Description of Artificial Sequence: Synthetic polypeptide
QDIQMTQSPSSLSASVGDRVTITCRASQSINTYLNWYQQKPGKAPKVLIHAASTLESGVPSRFSGSGSGTDFTLTISSLQPEDFATYYCQQSYSTPYTFGQGTKLEVR

SEQ ID NO: 786 - protein, 135 aa, Artificial Sequence
  Description of Artificial Sequence: Synthetic polypeptide
EVQLLESGGGLVQPGGSLRLSCAASGFTFSDYDMEWVRQAPGKGLEWVSSISPSGGSTIYADSVKGRFTISRDNSKNTLYLQMNSLRAEDTAVYYCARQGLLTAFDIWGQGTMVTVSSASTKGPSVFPLAPSSKS

SEQ ID NO: 787 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPITFGGGTKVEIK

SEQ ID NO: 788 - protein, 136 aa, Artificial Sequence
  Description of Artificial Sequence: Synthetic polypeptide
EVQLLESGGGLVQPGGSLRLSCAASGFTFSYYTMLWVRQAPGKGLEWVSSIYPSGGFTMYADSVKGRFTISRDNSKNTLYLQMNSLRAEDTAVYYCARVDTAMAMIDYWGQGTLVTVSSASTKGPSVFPLAPSSKS

SEQ ID NO: 789 - protein, 108 aa, Artificial Sequence
  Description of Artificial Sequence: Synthetic polypeptide
QDIQMTQSPSSLSASVGDRVIITCRASRSIATYLNWYQQKPGKAPNLLIFGASTLQSGVPSRFSGSGSGTDFTLTISDLQPEDFATYYCQQSFSDPYTFGQGTNLEMK

SEQ ID NO: 790 - protein, 137 aa, Artificial Sequence
  Description of Artificial Sequence: Synthetic polypeptide
EVQLLESGGGLVQPGGSLRLSCAASGFTFSAYMMIWVRQAPGKGLEWVSVIYPSGGVTMYADSVKGRFTISRDNSKNTLYLQMNSLRAEDTAVYYCARGTVGASDAFDIWGQGTMVTVSSASTKGPSVFPLAPSSKS

SEQ ID NO: 791 - protein, 106 aa, Artificial Sequence
  Description of Artificial Sequence: Synthetic polypeptide
QYELTQAPSVSVAPGQTASITCSGDKLGNRYTSWYQQKPGQSPVLVIFQDNKRPSGIPERFSGSNSGNTATLTISGTQAMDEADYYCQALDSNTYVFGTGTKVTVL

SEQ ID NO: 792 - protein, 139 aa, Artificial Sequence
  Description of Artificial Sequence: Synthetic polypeptide
EVQLLESGGGLVQPGGSLRLSCAASGFTFSWYSMGWVRQAPGKGLEWVSYIVPSGGYTMYADSVKGRFTISRDNSKNTLYLQMNSLRAEDTAVYYCARDPGVSYYYYGMDVWGQGTTVTVSSASTKGPSVFPLAPSSKS

SEQ ID NO: 793 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTRLEIK

SEQ ID NO: 794 - protein, 137 aa, Artificial Sequence
  Description of Artificial Sequence: Synthetic polypeptide
EVQLLESGGGLVQPGGSLRLSCAASGFTFSAYTMWWVRQAPGKGLEWVSSIWPSGGSTFYADSVKGRFTISRDNSKNTLYLQMNSLRAEDTAVYYCARTYDSSAGEVDYWGQGTLVTVSSASTKGPSVFPLAPSSKS

SEQ ID NO: 795 - protein, 108 aa, Artificial Sequence; identical to SEQ ID NO: 751
  Description of Artificial Sequence: Synthetic polypeptide

SEQ ID NO: 796 - protein, 138 aa, Artificial Sequence; identical to SEQ ID NO: 752
  Description of Artificial Sequence: Synthetic polypeptide

SEQ ID NO: 797 - protein, 108 aa, Artificial Sequence
  Description of Artificial Sequence: Synthetic polypeptide
QDIQMTQSPLSLSAFVGDRVTITCRASRDISVYLNWYQLKSGKAPKLLIYGASSLQSGVPSRFSGSGSGTDFTLTITSLQPEDFATYYCQQSYSIPFTFGGGTKVETK

SEQ ID NO: 798 - protein, 134 aa, Artificial Sequence
  Description of Artificial Sequence: Synthetic polypeptide
EVQLLESGGGLVQPGGSLRLSCAASGFTFSLYLMHWVRQAPGKGLEWVSSIYSSGGFTTYADSVKGRFTISRDNSKNTLYLQMNSLRAEDTAVYYCARDTDYGMDVWGQGTTVTVSSASTKGPSVFPLAPSSKS

SEQ ID NO: 799 - protein, 108 aa, Artificial Sequence
  Description of Artificial Sequence: Synthetic polypeptide
QDIQMTQSPSSLSASVGDGVTITCRASQSISTYLNWYQQRPGKAPKLLIYGASSLQSGVPSRFSGSGSGTDFTLTISSLQREDFATYYCQQSFSTPWTFGQGTRVEIK

SEQ ID NO: 800 - protein, 136 aa, Artificial Sequence
  Description of Artificial Sequence: Synthetic polypeptide
EVQLLESGGGLVQPGGSLRLSCAASGFTFSWYEMSWVRQAPGKGLEWVSRIWPSGGVTMYADSVKGRFTISRDNSKNTLYLQMNSLRAEDTAVYYCTRTSITTVGMDVWGQGTTVTVSSASTKGPSVFPLAPSSKS

SEQ ID NO: 801 - protein, 108 aa, Artificial Sequence
  Description of Artificial Sequence: Synthetic polypeptide
QDIQMTQSPSSLSASVGDRVTITCRASQSISIYLNWYQQKPEKAPKLLIFAASTLQSGVPSRFSGSGSGTDFTLTISNLQPEDFATYYCQQSHSIPPTFGLGTKVEVK

SEQ ID NO: 802 - protein, 136 aa, Artificial Sequence
  Description of Artificial Sequence: Synthetic polypeptide
EVQLLESGGGLVQPGGSLRLSCAASGFTFSMYPMMWVRQAPGKGLEWVSYISPSGGMTDYADSVKGRFTISRDNSKNTLYLQMNSLRAEDMAVYYCARVAGSSDAFDIWGQGTMVTVSSASTKGPSVFPLAPSSKS

SEQ ID NO: 803 - protein, 113 aa, Artificial Sequence
  Description of Artificial Sequence: Synthetic polypeptide
QDIQMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGPGTKVHIK

SEQ ID NO: 804 - protein, 131 aa, Artificial Sequence
  Description of Artificial Sequence: Synthetic polypeptide
EVQLLESGGGLVQPGGSLRLSCAASGFTFSAYPMNWVRQAPGKGLEWVSRISSSGGNTSYADSVKGRFTISRDNSKNTLYLQMNSLRAEDTAVYYCALGYLGYWGQGTLVTVSSASTKGPSVFPLAPSSKS

SEQ ID NO: 805 - protein, 108 aa, Artificial Sequence
  Description of Artificial Sequence: Synthetic polypeptide
QDIQMTQSPSSLSASVGDRVTITCRASQSISTYLNWYQQKPGKAPKLLIYGASSLQSGVPSRFSGSGSGTDFTLTISSLQPEDFTIYYCQQSYSDPYTFGQGTKLDIK

SEQ ID NO: 806 - protein, 136 aa, Artificial Sequence
  Description of Artificial Sequence: Synthetic polypeptide
EVQLLESGGGLVQPGGSLRLSCAASGFTFSLYRMFWVRQAPGKGLEWVSSIWSSGGPTMYADSVKGRFTISRDNSKNTLYLQMNSLRAEDTAVYYCAREYPSTYYFDYWGQGTLVTVSSASTKGPSVFPLAPSSKS

SEQ ID NO: 807 - protein, 108 aa, Artificial Sequence
  Description of Artificial Sequence: Synthetic polypeptide
QDIQMTQSPSSLSASVGDRVTITCRASQTIDDDLIWYQQKPGRAPKLLIYAASSLQSGVPSRFSGSGSGTDFTLTITSLQPEDFATYYCQQSYNIPRTFGQGTKLESK

SEQ ID NO: 808 - protein, 141 aa, Artificial Sequence
  Description of Artificial Sequence: Synthetic polypeptide
EVQLLESGGGLVQPGGSLRLSCAASGFTFSNYDMMWVRQAPGKGLEWVSYISPSGGFTRYADSVKGRFTISRDNSKNTLYLQMNSLRAEDTATYYCAKDIYYYNWGPSHYFDSWGQGTLVTVSSASTKGPSVFPLAPSSKS

SEQ ID NO: 809 - protein, 108 aa, Artificial Sequence
  Description of Artificial Sequence: Synthetic polypeptide
QDIQMTQSPSSLSASVGDSVTITCRASQSISGYINWYQQKAGKAPKLLIYAASSLQSGVPSRFSGSGSGTHFTLTISSLQPEDFATYYCQQYVSYPFTFGPGTKVDIK

SEQ ID NO: 810 - protein, 138 aa, Artificial Sequence
  Description of Artificial Sequence: Synthetic polypeptide
EVQLLESGGGLVQPGGSLRLSCAASGFTFSQYGMQWVRQAPGKGLEWVSSIRSSGGATRYADSVKGRFTISRDNSKNTLYLQMNSLRAEDTAVYYCARDGYYDSSGYPDYWGQGTLVTVSSASTKGPSVFPLAPSSKS

SEQ ID NO: 811 - protein, 108 aa, Artificial Sequence
  Description of Artificial Sequence: Synthetic polypeptide
QDIQMTQSPSSLSASVGDRVAITCRASQSIDTYLNWYQQKPGKAPKLLIYDASNLEIGVPSRFSGSGSGTDFTFIINSLQPEDVATYYCQHYLYAPYSFGQGTKLEIK

SEQ ID NO: 812 - protein, 137 aa, Artificial Sequence
  Description of Artificial Sequence: Synthetic polypeptide
EVQLLESGGGLVQPGGSLRLSCAASGFTFSNYWMMWVRQAPGKGLEWVSGIGSSGGFTSYADSVKGRFTISRDNSKNTLYLQMNSLRAEDTAVYYCAKGSYSDYGVFESWGQGTLVTVSSASTKGPSVFPLAPSSKS

SEQ ID NO: 813 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIK

SEQ ID NO: 814 - protein, 136 aa, Artificial Sequence
  Description of Artificial Sequence: Synthetic polypeptide
EVQLLESGGGLVQPGGSLRLSCAASGFTFSTYEMYWVRQAPGKGLEWVSGIGSSGGMTMYADSVKGRFTISRDNSKNTLYLQMNSLRAEDTAMYYCAREQPGIAALQFWGQGTLVTVSSASTKGPSVFPLAPSSKS

SEQ ID NO: 815 - protein, 108 aa, Artificial Sequence
  Description of Artificial Sequence: Synthetic polypeptide
QDIQMTQSPSSLSASVGDRVTITCRASQSISIYLTWYQHRPGKAPNLLIYGAATLQTGVPSRFSGSGSGTDFTLTIRGLQPEDFATYYCQQTFSLPRTFGQGTKLEIK

SEQ ID NO: 816 - protein, 138 aa, Artificial Sequence
  Description of Artificial Sequence: Synthetic polypeptide
EVQLLESGGGLVQPGGSLRLSCAASGFTFSMYHMNWVRQAPGKGLEWVSGIVSSGGVTFYADSVKGRFTISRDNSKNTLYLQMNSLRAEDTAVYYCARITTVTTGGAFDIWGQGTMVTVSSASTKGPSVFPLAPSSKS

SEQ ID NO: 817 - protein, 108 aa, Artificial Sequence
  Description of Artificial Sequence: Synthetic polypeptide
QDIQMTQSPSSLSASVGDTVTITCRTSQTINNYLNWYQQRPGEAPKVLIYATHTLESGVPSRFSGSGSGTDFTLTIGSLQPEDFATYYCQQSFAFPYTFGQGTKVEIT

SEQ ID NO: 818 - protein, 135 aa, Artificial Sequence
  Description of Artificial Sequence: Synthetic polypeptide
EVQLLESGGGLVQPGGSLRLSCAASGFTFSWYTMGWVRQAPGKGLEWVSWIYFGGLTTYADSVKGRFTISRDNSKNTLYLQMNSLRAEDTAVYYCARLGGPLDAFDIWGQGTMVTVSSASTKGPSVFPLAPSSKS

SEQ ID NO: 819 - protein, 108 aa, Artificial Sequence
  Description of Artificial Sequence: Synthetic polypeptide
QDIQMTQSPSSLSASIGDRVTISCRASRGIGTYLNWYQQHAGKAPKLLIRAASSLETGVPPRFSGSGSGTDFTLTISSLQSDDFATYYCQESFTNVYNFGQGTKLEIK

SEQ ID NO: 820 - protein, 137 aa, Artificial Sequence
  Description of Artificial Sequence: Synthetic polypeptide
EVQLLESGGGLVQPGGSLRLSCAASGFTFSQYAMHWVRQAPGKGLEWVSSIYPSGGFTLYADSVKGRFTISRDNSKNTLYLQMNSLRAEDTAMYYCARGGWLAGGELLNWGQGTLVTVSSASTKGPSVFPLAPSSKS

SEQ ID NO: 821 - protein, 108 aa, Artificial Sequence
  Description of Artificial Sequence: Synthetic polypeptide
QDIQMTQSPSSLSASVGDRVTITCRTSQGINHYLNWYQQKPGKAPKILVFAASELQTGVPSRFSGTGSGTSYTLTITSLQPEDVATYYCQQTYTSPYTFGQGTKLEVK

SEQ ID NO: 822 - protein, 138 aa, Artificial Sequence
  Description of Artificial Sequence: Synthetic polypeptide
EVQLLESGGGLVQPGGSLRLSCAASGFTFSLYNMTWVRQAPGKGLEWVSYIYPSGGGTHYADSVKGRFTISRDNSKNTLYLQMNSLRAEDTAVYYCARDTGFWSADAFDIWGQGTMVTVSSASTKGPSVFPLAPSSKS

SEQ ID NO: 823 - protein, 108 aa, Artificial Sequence
  Description of Artificial Sequence: Synthetic polypeptide
QDIQMTQSPSSLSAFVGDRVSITCRASQTISVYVNWYQHKSGQAPKLLIYGASSLQSGVPSRFSGSGSGTDFTLTISSLQPEDFATYFCQQSYSIPFTFGGGTDVQIR

SEQ ID NO: 824 - protein, 135 aa, Artificial Sequence
  Description of Artificial Sequence: Synthetic polypeptide
EVQLLESGGGLVQPGGSLRLSCAASGFTFSQYPMNWVRQAPGKGLEWVSSISSSGGFTTYADSVKGRFTISRDNSKNTLYLQMNSLRAEDTAVYYCAREEQQGGFDYWGQGTLVTVSSASTKGPSVFPLAPSSKS

SEQ ID NO: 825 - protein, 108 aa, Artificial Sequence
  Description of Artificial Sequence: Synthetic polypeptide
QDIQMTQSPSSLSASVGDRVTITCRASQSISRYLNWYQQKPGKAPKLLIYAASTLETGVPSRFSGSGSGTDFTLTITTLQPEDFVIYYCQQSYSTPYTFGQGTKLEIK

SEQ ID NO: 826 - protein, 137 aa, Artificial Sequence
  Description of Artificial Sequence: Synthetic polypeptide
EVQLLESGGGLVQPGGSLRLSCAASGFTFSWYYMGWVRQAPGKGLEWVSWIVSSGGLTLYADSVKGRFTISRDNSKNTLYLQMNSLRAEDTAMYYCARTTVTTGDAFDIWGQGTMVTVSSASTKGPSVFPLAPSSKS

SEQ ID NO: 827 - protein, 108 aa, Artificial Sequence
  Description of Artificial Sequence: Synthetic polypeptide
QDIQMTQSPSSLSASVGDRVTITCRASQGIRNDLGWYQHKPGKAPKLLIYAASILQSGVPSRFSGTASGTDFTLTISSLQPEDFATYFCLQDYEYPLTFGGGTKLDIK

SEQ ID NO: 828 - protein, 135 aa, Artificial Sequence
  Description of Artificial Sequence: Synthetic polypeptide
EVQLLESGGGLVQPGGSLRLSCAASGFTFSLYSMYWVRQAPGKGLEWVSRIRPSGGGTVYADSVKGRFTISRDNSKNTLYLQMNSLRAEDTAVYYCARDPLYSSGDVWGQGTTVTVSSASTKGPSVFPLAPSSKS

SEQ ID NO: 829 - protein, 108 aa, Artificial Sequence
  Description of Artificial Sequence: Synthetic polypeptide
QDIQMTQSPSSLSASVGDRVTITCRASQSIGIYLNWYHQKPGKAPNLLIYGASSLQSGVPSRFSGSGSGTDFTLTISSLQPGDFATYYCQHSYSTPFTFGGGTKVEIK

SEQ ID NO: 830 - protein, 137 aa, Artificial Sequence
  Description of Artificial Sequence: Synthetic polypeptide
EVQLLESGGGLVQPGGSLRLSCAASGFTFSSYAMVWVRQAPGKGLEWVSSIGSSGGFTLYADSVKGRFTISRDNSKNTLYLQMNSLRAEDTAVYYCASMNLGGGDAFDIWGQGTMVTVSSASTKGPSVFPLAPSSKS

SEQ ID NO: 831 - protein, 110 aa, Artificial Sequence
  Description of Artificial Sequence: Synthetic polypeptide
QSALTQPPSVSVSPGQTASITCSGDKLGEKYVSWYQQKPGQSPVVVIYQDNKRPSGIPERFSGSNSGNTATLTISGTQAVDEADYYCQAWDSYTVVFGGGSKLTVLGQPK

SEQ ID NO: 832 - protein, 142 aa, Artificial Sequence
  Description of Artificial Sequence: Synthetic polypeptide
EVQLLESGGGLVQPGGSLRLSCAASGFTFSDYEMHWVRQAPGKGLEWVSGISPSGGKTQYADSVKGRFTISRDNSKNTLYLQMNSLRAEDTAVYYCARDLKWGGRGSPDWYFDLWGRGTLVTVSSASTKGPSVFPLAPSSKS

SEQ ID NO: 833 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGGGTKVEIK

SEQ ID NO: 834 - protein, 137 aa, Artificial Sequence
  Description of Artificial Sequence: Synthetic polypeptide
EVQLLESGGGLVQPGGSLRLSCAASGFTFSNYPMDWVRQAPGKGLEWVSSISSSGGWTNYADSVKGRFTISRDNSKNTLYLQMNSLRAEDTAVYYCATDTSGSYLGFDYWGQGTLVTVSSASTKGPSVFPLAPSSKS

SEQ ID NO: 835 - protein, 108 aa, Artificial Sequence
  Description of Artificial Sequence: Synthetic polypeptide
QDIQMTQSPSSLSASVGDRVSITCRASQSISTYLNWYQHKPGKAPTLLIYGAFSLQSGVPSRFSGSGSGTDFALTISSLQPEDFATYYCQQSHSTPPTFGQGTRVEIK

SEQ ID NO: 836 - protein, 137 aa, Artificial Sequence
  Description of Artificial Sequence: Synthetic polypeptide
EVQLLESGGGLVQPGGSLRLSCAASGFTFSQYKMLWVRQAPGKGLEWVSGIGPSGGLTAYADSVKGRFTISRDNSKNTLYLQMNSLRAEDTAVYYCARAPWFGELGMDVWGQGTTVTVSSASTKGPSVFPLAPSSKS

SEQ ID NO: 837 - protein, 108 aa, Artificial Sequence
  Description of Artificial Sequence: Synthetic polypeptide
QDIQMTQSPSSLSASVGDRVTITCRASQSISAYLNWYQQKPGKAPQLLMYGVGSLQSGVPSRFSGSGSGTDFTLTISSLQPEDFATYFCQQGYTTPVTFGGGTKVEIK

SEQ ID NO: 838 - protein, 137 aa, Artificial Sequence
  Description of Artificial Sequence: Synthetic polypeptide
EVQLLESGGGLVQPGGSLRLSCAASGFTFSWYRMDWVRQAPGKGLEWVSSIWPSGGLTSYADSVKGRFTISRDNSKNTLYLQMNSLRAEDTAVYYCARGWAPGGDAFDIWGQGTMVTVSSASTKGPSVFPLAPSSKS

SEQ ID NO: 839 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 840 - protein, 138 aa, Artificial Sequence
  Description of Artificial Sequence: Synthetic polypeptide
EVQLLESGGGLVQPGGSLRLSCAASGFTFSDYTMWWVRQAPGKGLEWVSSISSSGGITFYADSVKGRFTISRDNSKNTLYLQMNSLRAEDTAVYYCARSADTAMGGAFDIWGQGTMVTVSSASTKGPSVFPLAPSSKS

SEQ ID NO: 841 - protein, 106 aa, Artificial Sequence
  Description of Artificial Sequence: Synthetic polypeptide
QYELTQPPAVSVSPGQTATITCSGDKLGDEYAAWYQQKPGQSPVLVIYQDRKRPSGIPERFSGSNFGNTATLTITGTQVMDEADYYCQAWGKRNVVFGGGTKLTVL

SEQ ID NO: 842 - protein, 139 aa, Artificial Sequence
  Description of Artificial Sequence: Synthetic polypeptide
EVQLLESGGGLVQPGGSLRLSCAASGFTFSWYQMMWVRQAPGKGLEWVSSISPSGGITEYADSVKGRFTISRDNSKNTLYLQMNSLRAEDTAVYYCARDRSSGWYYYGMDVWGQGTTVTVSSASTKGPSVFPLAPSSKS

SEQ ID NO: 843 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 844 - protein, 136 aa, Artificial Sequence
  Description of Artificial Sequence: Synthetic polypeptide
EVQLLESGGGLVQPGGSLRLSCAASGFTFSSYMMHWVRQAPGKGLEWVSGIYPSGGWTDYADSVKGRFTISRDNSKNTLYLQMNSLRAEDTATYYCARLVAGLDAFDIWGQGTMVTVSSASTKGPSVFPLAPSSKS

SEQ ID NO: 845 - protein, 108 aa, Artificial Sequence; identical to SEQ ID NO: 813
  Description of Artificial Sequence: Synthetic polypeptide

SEQ ID NO: 846 - protein, 137 aa, Artificial Sequence
  Description of Artificial Sequence: Synthetic polypeptide
EVQLLESGGGLVQPGGSLRLSCAASGFTFSWYPMTWVRQAPGKGLEWVSSIGPSGGQTIYADSVKGRFTISRDNSKNTLYLQMNSLRAEDTAVYYCTTEYGDYGGGFDPWGQGTLVTVSSASTKGPSVFPLAPSSKS

SEQ ID NO: 847 - protein, 108 aa, Artificial Sequence
  Description of Artificial Sequence: Synthetic polypeptide
QDIQMTQSPSFLSASVGDRVTITCRASQGISSYLAWYQQKPGKAPKLLIYAASSLQSGVPSRFSGSGSGTDFTLTISSLQPEDFATYYCQQSYNTLRTFGPGTKVDLK

SEQ ID NO: 848 - protein, 139 aa, Artificial Sequence
  Description of Artificial Sequence: Synthetic polypeptide
EVQLLESGGGLVQPGGSLRLSCAASGFTFSSYHMMWVRQAPGKGLEWVSSIYPSGGATMYADSVKGRFTISRDNSKNTLYLQMNSLRAEDTAMYYCARDGYHYGDYTYFQHWGQGTLVTVSSASTKGPSVFPLAPSSKS

SEQ ID NO: 849 - protein, 108 aa, Artificial Sequence; identical to SEQ ID NO: 805
  Description of Artificial Sequence: Synthetic polypeptide

SEQ ID NO: 850 - protein, 136 aa, Artificial Sequence; identical to SEQ ID NO: 806
  Description of Artificial Sequence: Synthetic polypeptide

SEQ ID NO: 851 - protein, 108 aa, Artificial Sequence
  Description of Artificial Sequence: Synthetic polypeptide
QDIQMTQSPSSLSASVGDRVTITCRASQRISYYLTWYQQKPGKVPKLLIYAASSLESGVPSRFSGSGSGTDFTLTISNLQPEDFATYYCQQAFSTPFTFGGGTKVEIK

SEQ ID NO: 852 - protein, 136 aa, Artificial Sequence
  Description of Artificial Sequence: Synthetic polypeptide
EVQLLESGGGLVQPGGSLRLSCAASGFTFSAYYMVWVRQAPGKGLEWVSYISPSGGQTQYADSVKGRFTISRDNSKNTLYLQMNSLRAEDTAVYYCAREAISSSSFDYWGQGTLVTVSSASTKGPSVFPLAPSSKS

SEQ ID NO: 853 - protein, 108 aa, Artificial Sequence
  Description of Artificial Sequence: Synthetic polypeptide
QDIQMTQSPSSVSASVGDRITITCRTRQSISNYLNWYQQKPGEPPKLLIFAASSLQSGVPSRFSGSGTGTEFTLTISSLQPEDLAIYYCQQSYDIPFTFGQGTKLEIK

SEQ ID NO: 854 - protein, 136 aa, Artificial Sequence
  Description of Artificial Sequence: Synthetic polypeptide
EVQLLESGGGLVQPGGSLRLSCAASGFTFSEYDMAWVRQAPGKGLEWVSYIVSSGGFTSYADSVKGRFTISRDNSKNTLYLQMNSLRAEDTAVYYCTTWAGWIAAADYWGQGTLVTVSSASTKGPSVFPLAPSSKS

SEQ ID NO: 855 - protein, 108 aa, Artificial Sequence
  Description of Artificial Sequence: Synthetic polypeptide
QDIQMTQSPSSLSASVGDRVTITCRASQSISNYLNWYQQKPGKAPKFLIYAASSLQSGVPSRFSGSGSGTDFTLSISSLQPEDFATYYCQQSYSTPQTFGQGTKVEMK

SEQ ID NO: 856 - protein, 136 aa, Artificial Sequence
  Description of Artificial Sequence: Synthetic polypeptide
EVQLLESGGGLVQPGGSLRLSCAASGFTFSAYQMAWVRQAPGKGLEWVSVIYSSGGYTDYADSVKGRFTISRDNSKNTLYLQMNSLRAEDTAVYYCARHNWNDGAFDIWGQGTMVTVSSASTKGPSVFPLAPSSKS

SEQ ID NO: 857 - protein, 107 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGGGTKVEIK

SEQ ID NO: 858 - protein, 137 aa, Artificial Sequence
  Description of Artificial Sequence: Synthetic polypeptide
EVQLLESGGGLVQPGGSLRLSCAASGFTFSWYAMHWVRQAPGKGLEWVSGIYSSGGYTKYADSVKGRFTISRDNSKNTLYLQMNSLRAEDTAVYYCARDLSNGDDVFDIWGQGTMVTVSSASTKGPSVFPLAPSSKS

SEQ ID NO: 859 - protein, 108 aa, Artificial Sequence
  Description of Artificial Sequence: Synthetic polypeptide
QDIQMTQSPSSLSASVGDRVTITCRASQSINFYLNWYQQKPGKAPKLLIYVASSLESGVPSRFSGSASGTEFTLTISSLQPEDFATYYCLQSYSAPYTFGQGTKVEIT

SEQ ID NO: 860 - protein, 137 aa, Artificial Sequence
  Description of Artificial Sequence: Synthetic polypeptide
EVQLLESGGGLVQPGGSLRLSCAASGFTFSYYQMGWVRQAPGKGLEWVSSIYPSGGMTDYADSVKGRFTISRDNSKNTLYLQMNSLRAEDTAVYYCTRGSPWGDDAFDIWGQGTMVTVSSASTKGPSVFPLAPSSKS

SEQ ID NO: 861 - protein, 108 aa, Artificial Sequence
  Description of Artificial Sequence: Synthetic polypeptide
QDIQMTQSPSSLSASEGDMVTITCRTSRRIGTYLNWYQQKPGKAPKLLIYGASSLQSGVPSRFSGSGSGTDFTLTVSSLQPEDVGTYYCQQSFSSPWTFGPGTKVEIK

SEQ ID NO: 862 - protein, 137 aa, Artificial Sequence
  Description of Artificial Sequence: Synthetic polypeptide
EVQLLESGGGLVQPGGSLRLSCAASGFTFSWYPMQWVRQAPGKGLEWVSYIYPSGGGTDYADSVKGRFTISRDNSKNTLYLQMNSLRAEDTATYYCATSSGWLGDAFDIWGQGTMVTVSSASTKGPSVFPLAPSSKS

SEQ ID NO: 863 - protein, 110 aa, Artificial Sequence
  Description of Artificial Sequence: Synthetic polypeptide
QDIQMTQSPSSLSASVGDRVTITCRASQSIATYLNWYQQKPGRAPKLLIYAASSLQSGVPSRFVGGGSGSGTHFTLTISSLQPEDFATYYCQQSYSTRETFGQGTKVEIK

SEQ ID NO: 864 - protein, 137 aa, Artificial Sequence
  Description of Artificial Sequence: Synthetic polypeptide
EVQLLESGGGLVQPGGSLRLSCAASGFTFSWYTMHWVRQAPGKGLEWVSVIYPSGGPTSYADSVKGRFTISRDNSKNTLYLQMNSLRAEDTATYYCARDGSGSYLGFDYWGQGTLVTVSSASTKGPSVFPLAPSSKS

SEQ ID NO: 865 - protein, 108 aa, Artificial Sequence; identical to SEQ ID NO: 783
  Description of Artificial Sequence: Synthetic polypeptide

SEQ ID NO: 866 - protein, 135 aa, Artificial Sequence; identical to SEQ ID NO: 784
  Description of Artificial Sequence: Synthetic polypeptide

SEQ ID NO: 867 - protein, 108 aa, Artificial Sequence
  Description of Artificial Sequence: Synthetic polypeptide
QDIQMTQSPSSVSASVGDRVTINCRASQDISNWLAWYQQKPGKAPNLLIYAASSLQTGAPSRFSGSGSGTDFTLTISSLQPEDFGTYVCQQSYSLPWTFGLGTKVEVR

SEQ ID NO: 868 - protein, 141 aa, Artificial Sequence
  Description of Artificial Sequence: Synthetic polypeptide
EVQLLESGGGLVQPGGSLRLSCAASGFTFSLYDMTWVRQAPGKGLEWVSGISSSGGVTIYADSVKGRFTISRDNSKNTLYLQMNSLRAEDTAVYYCARTYYYDSSGYADAFDIWGQGTMVTVSSASTKGPSVFPLAPSSKS

SEQ ID NO: 869 - protein, 108 aa, Artificial Sequence
  Description of Artificial Sequence: Synthetic polypeptide
QDIQMTQSPSSLSASVGDRVTITCRASQSINTYLNWYQQKPGKAPKVLIHAASTLESGVPSRFSGSGSGTDFTLTISSLQPEDFATYYCQQSYSTPPTFGQGTKVEIK

SEQ ID NO: 870 - protein, 135 aa, Artificial Sequence
  Description of Artificial Sequence: Synthetic polypeptide
EVQLLESGGGLVQPGGSLRLSCAASGFTFSVYLMHWVRQAPGKGLEWVSGISPSGGYTQYADSVKGRFTISRDNSKNTLYLQMNSLRAEDTAVYYCARPGGLDAFDIWGQGTMVTVSSASTKGPSVFPLAPSSKS

SEQ ID NO: 871 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 872 - protein, 136 aa, Artificial Sequence
  Description of Artificial Sequence: Synthetic polypeptide
EVQLLESGGGLVQPGGSLRLSCAASGFTFSRYIMWWVRQAPGKGLEWVSGIYSSGGYTQYADSVKGRFTISRDNSKNTLYLQMNSLRAEDTAMYYCARELEGLGGFDYWGQGTLVTVSSASTKGPSVFPLAPSSKS

SEQ ID NO: 873 - protein, 108 aa, Artificial Sequence
  Description of Artificial Sequence: Synthetic polypeptide
QDIQMTQSPSSVSASVGDRVTITCRASQGISSWLAWYQQKPGKAPKLLIYATSGLQSGVPSRFSGSGSGTDFTLTISSLQPEDFATYYCQQAKSFPLTFGGGTRVEIK

SEQ ID NO: 874 - protein, 139 aa, Artificial Sequence
  Description of Artificial Sequence: Synthetic polypeptide
EVQLLESGGGLVQPGGSLRLSCAASGFTFSDYTMYWVRQAPGKGLEWVSSIVPSGGHTLYADSVKGRFTISRDNSKNTLYLQMNSLRAEDTAVYYCAKDHLSSWYGGFFDYWGQGTLVTVSSASTKGPSVFPLAPSSKS

SEQ ID NO: 875 - protein, 108 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTRYTFGQGTKLEIK

SEQ ID NO: 876 - protein, 136 aa, Artificial Sequence
  Description of Artificial Sequence: Synthetic polypeptide
EVQLLESGGGLVQPGGSLRLSCAASGFTFSGYDMMWVRQAPGKGLEWVSVISSSGGNTAYADSVKGRFTISRDNSKNTLYLQMNSLRAEDTAVYYCARESSGLYYFDYWGQGTLVTVSSASTKGPSVFPLAPSSKS

SEQ ID NO: 877 - protein, 108 aa, Artificial Sequence
  Description of Artificial Sequence: Synthetic polypeptide
QDIQMTQSPSSLSASVGDTVSITCRASQSITIYLNWYQHKPGKAPNLLIYGASNLHSGVPSRFSGSGSGTDFTLTISSLQPEDFATYYCQQSYDTPLTFGGGTKVEIK

SEQ ID NO: 878 - protein, 136 aa, Artificial Sequence
  Description of Artificial Sequence: Synthetic polypeptide
EVQLLESGGGLVQPGGSLRLSCAASGFTFSWYPMYWVRQAPGKGLEWVSSIGSSGGPTPYADSVKGRFTISRDNSKNTLYLQMNSLRAEDTAVYYCARWADYGGSLDYWGQGTLVTVSSASTKGPSVFPLAPSSKS

SEQ ID NO: 879 - protein, 110 aa, Artificial Sequence
  Description of Artificial Sequence: Synthetic polypeptide
QSVLTQPPSVSEAPRQRVTISCSGSSSNIGNNAVSWYQQLPGKAPKLLIYYDDLLPSGVSDRFSGSKSGTSASLAISGLRSEDEADYYCAAWDDSLNGFVFGTGTKVTVL

SEQ ID NO: 880 - protein, 137 aa, Artificial Sequence
  Description of Artificial Sequence: Synthetic polypeptide
EVQLLESGGGLVQPGGSLRLSCAASGFTFSRYPMMWVRQAPGKGLEWVSVIYPSGGDTFYADSVKGRFTISRDNSKNTLYLQMNSLRAEDTAVYYCASGDDYLWEAAVYWGQGTLVTVSSASTKGPSVFPLAPSSKS

SEQ ID NO: 881 - protein, 110 aa, Artificial Sequence
  Description of Artificial Sequence: Synthetic polypeptide
QDIQMTQSPATLSASPGETVTLSCRASQNIGNDVAWYRQRPGQAPRLLIHHASTRAYGIPARLRGSGSATEFTLTITSLEPEDFAIYYCQQFYDWPAHTFALGTRLEIKR

SEQ ID NO: 882 - protein, 140 aa, Artificial Sequence
  Description of Artificial Sequence: Synthetic polypeptide
EVQLLESGGGLVQPGGSLRLSCAASGFTFSYYHMWWVRQAPGKGLEWVSGISPSGGFTFYADSVKGRFTISRDNSKNTLYLQMNSLRAEDTAVYYCARDYYYDSSGYSPLGYWGQGTLVTVSSASTKGPSVFPLAPSSKS

SEQ ID NO: 883 - protein, 108 aa, Artificial Sequence
  Description of Artificial Sequence: Synthetic polypeptide
QDIQMTQSPSSLSSSVGDSATITCRASQSISIYLNWYQQKPGKAPKILIYGASQLESGVPSRFSGSGSGTDFTLTVSGLQPEDFATYWCQQSYNVPYTFGQGTKLEIK

SEQ ID NO: 884 - protein, 136 aa, Artificial Sequence
  Description of Artificial Sequence: Synthetic polypeptide
EVQLLESGGGLVQPGGSLRLSCAASGFTFSFYKMIWVRQAPGKGLEWVSSISSSGGSTQYADSVKGRFTISRDNSKNTLYLQMNSLRAEDTAVYYCARDRVDLGYLDYWGQGTLVTVSSASTKGPSVFPLAPSSKS

SEQ ID NO: 885 - protein, 108 aa, Artificial Sequence
  Description of Artificial Sequence: Synthetic polypeptide
QDIQMTQSPSSLSASVRDRVTITCRTSQNINTYLNWYYQAPGRAPKLLIFGVSSLHRGVSSRFSGSGDGTEFTLTISSLQPEDIGTYFCQQSYSSPWTFGQGTKVEIK

SEQ ID NO: 886 - protein, 136 aa, Artificial Sequence
  Description of Artificial Sequence: Synthetic polypeptide
EVQLLESGGGLVQPGGSLRLSCAASGFTFSQYLMMWVRQAPGKGLEWVSSIYPSGGYTSYADSVKGRFTISRDNSKNTLYLQMNSLRAEDTAVYYCARVSTAVADNDYWGQGTLVTVSSASTKGPSVFPLAPSSKS

SEQ ID NO: 887 - protein, 109 aa, Artificial Sequence
  Description of Artificial Sequence: Synthetic polypeptide
QDIQMTQSPSSLSASVGDRVTITCRASQTIDNYLHWYQQKPGKAPKVLIHDASSLQSGVPPRFSGSGSGTDFTLTISSLQPEDFATYYCQQSYDTPQYTFGQGTKLEIK

SEQ ID NO: 888 - protein, 135 aa, Artificial Sequence
  Description of Artificial Sequence: Synthetic polypeptide
EVQLLESGGGLVQPGGSLRLSCAASGFTFSLYDMNWVRQAPGKGLEWVSGISPSGGQTMYADSVKGRFTISRDNSKNTLYLQMNSLRAEDTAVYYCARQPMISAFDIWGQGTMVTVSSASTKGPSVFPLAPSSKS

SEQ ID NO: 889 - protein, 109 aa, Artificial Sequence
  Description of Artificial Sequence: Synthetic polypeptide
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPPWTFGQGTKVEIK

SEQ ID NO: 890 - protein, 136 aa, Artificial Sequence
  Description of Artificial Sequence: Synthetic polypeptide
EVQLLESGGGLVQPGGSLRLSCAASGFTFSLYAMWWVRQAPGKGLEWVSYISSSGGFTSYADSVKGRFTISRDNSKNTLYLQMNSLRAEDTAVYYCARYRVGVAATDYWGQGTLVTVSSASTKGPSVFPLAPSSKS

SEQ ID NO: 891 - protein, 108 aa, Artificial Sequence
  Description of Artificial Sequence: Synthetic polypeptide
QDIQMTQSPSSLSASVRDRVTITCRASQSISTYLNWYQQKPGEAPKLLVFAASSLQSGVPSRFSGSGSGTDFTLSISSLQPEDFATYYCQQSYSTPHTFGQGAKVEIK

SEQ ID NO: 892 - protein, 136 aa, Artificial Sequence
  Description of Artificial Sequence: Synthetic polypeptide
EVQLLESGGGLVQPGGSLRLSCAASGFTFSGYIMHWVRQAPGKGLEWVSWIYPSGGWTEYADSVKGRFTISRDNSKNTLYLQMNSLRAEDTAVYYCARDAPGVGAIDYWGQGTLVTVSSASTKGPSVFPLAPSSKS

SEQ ID NO: 893 - protein, 108 aa, Artificial Sequence
  Description of Artificial Sequence: Synthetic polypeptide
QDIQMTQSPSSLSASEGDRVTITCRASQDISVYLNWYQMKSGKAPKLLIYGGASLQSGVPARFSGSGYGTDFTLTITDLRPEDFATYYCQQSYSLPFTFGGGTKVEIK

SEQ ID NO: 894 - protein, 137 aa, Artificial Sequence
  Description of Artificial Sequence: Synthetic polypeptide
EVQLLESGGGLVQPGGSLRLSCAASGFTFSMYWMQWVRQAPGKGLEWVSYIYPSGGPTKYADSVKGRFTISRDNSKNTLYLQMNSLRAEDTAVYYCARPSGSYGDAFDIWGQGTMVTVSSASTKGPSVFPLAPSSKS

SEQ ID NO: 895 - protein, 108 aa, Artificial Sequence
  Description of Artificial Sequence: Synthetic polypeptide
QDIQMTQSPSTLSASVGDRVTITCRASQNISSYLNWYQQKPGKAPKLLIYAASSLQSGVPSRFSGSGSGTDFTLTISSLQPEDFATYSCQQSYSTPRTFGQGTKVEIK

SEQ ID NO: 896 - protein, 136 aa, Artificial Sequence
  Description of Artificial Sequence: Synthetic polypeptide
EVQLLESGGGLVQPGGSLRLSCAASGFTFSLYIMGWVRQAPGKGLEWVSGIYPSGGFTMYADSVKGRFTISRDNSKNTLYLQMNSLRAEDTAVYYCARESSGVAAPDYWGQGTLVTVSSASTKGPSVFPLAPSSKS

SEQ ID NO: 897 - protein, 112 aa, Artificial Sequence
  Description of Artificial Sequence: Synthetic polypeptide
QDIQMTQSPLSLPVTPGEPASISCRSSQSLLHSRGYNYLDWYLQKPGQSPQLLIYLGSNRASGVPDRFSGSGSGTDFTLKISRVEAEDVGVYYCMQALQRRTFGQGTKLEIK

SEQ ID NO: 898 - protein, 144 aa, Artificial Sequence
  Description of Artificial Sequence: Synthetic polypeptide
EVQLLESGGGLVQPGGSLRLSCAASGFTFSYYTMIWVRQAPGKGLEWVSGIRSSGGGTRYADSVKGRFTISRDNSKNTLYLQMNSLRAEDTAVYYCAKDGSRYSYGSIYYYYGMDAWGQGTTVTVSSASTKGPSVFPLAPSSKS

SEQ ID NO: 899 - protein, 17 aa, Artificial Sequence
  Description of Artificial Sequence: Synthetic peptide
GGLLLWFRELKSNYFDY

SEQ ID NO: 900 - DNA, 42 bp, Artificial Sequence
  Description of Artificial Sequence: Synthetic primer
  modified_base (22)..(23): a, c, t, g, unknown or other
ggcggtctattactatggttcnnkgagctgaagtctaactac

SEQ ID NO: 901 - DNA, 42 bp, Artificial Sequence
  Description of Artificial Sequence: Synthetic primer
  modified_base (19)..(20): a, c, t, g, unknown or other
ggcggtctattactatggnnkagggagctgaagtctaactac

SEQ ID NO: 902 - DNA, 42 bp, Artificial Sequence
  Description of Artificial Sequence: Synthetic primer
  modified_base (16)..(17): a, c, t, g, unknown or other
ggcggtctattactannkttcagggagctgaagtctaactac

SEQ ID NO: 903 - DNA, 42 bp, Artificial Sequence
  Description of Artificial Sequence: Synthetic primer
  modified_base (25)..(26): a, c, t, g, unknown or other
ggcggtctattactatggttcaggnnkctgaagtctaactac

SEQ ID NO: 904 - protein, 17 aa, Artificial Sequence
  Description of Artificial Sequence: Synthetic peptide
GGLLLWFRELKSNYFDY

SEQ ID NO: 905 - protein, 17 aa, Artificial Sequence
  Description of Artificial Sequence: Synthetic peptide
GGLLLAFRELKSNYFDY

SEQ ID NO: 906 - protein, 17 aa, Artificial Sequence
  Description of Artificial Sequence: Synthetic peptide
GGLLLCFRELKSNYFDY

SEQ ID NO: 907 - protein, 17 aa, Artificial Sequence
  Description of Artificial Sequence: Synthetic peptide
GGLLLDFRELKSNYFDY

SEQ ID NO: 908 - protein, 17 aa, Artificial Sequence
  Description of Artificial Sequence: Synthetic peptide
GGLLLEFRELKSNYFDY

SEQ ID NO: 909 - protein, 17 aa, Artificial Sequence
  Description of Artificial Sequence: Synthetic peptide
GGLLLGFRELKSNYFDY

SEQ ID NO: 910 - protein, 17 aa, Artificial Sequence
  Description of Artificial Sequence: Synthetic peptide
GGLLLKFRELKSNYFDY

SEQ ID NO: 911 - protein, 17 aa, Artificial Sequence
  Description of Artificial Sequence: Synthetic peptide
GGLLLLFRELKSNYFDY

SEQ ID NO: 912 - protein, 17 aa, Artificial Sequence
  Description of Artificial Sequence: Synthetic peptide
GGLLLMFRELKSNYFDY

SEQ ID NO: 913 - protein, 17 aa, Artificial Sequence
  Description of Artificial Sequence: Synthetic peptide
GGLLLPFRELKSNYFDY

SEQ ID NO: 914 - protein, 17 aa, Artificial Sequence
  Description of Artificial Sequence: Synthetic peptide
GGLLLQFRELKSNYFDY

SEQ ID NO: 915 - protein, 17 aa, Artificial Sequence
  Description of Artificial Sequence: Synthetic peptide
GGLLLRFRELKSNYFDY

SEQ ID NO: 916 - protein, 17 aa, Artificial Sequence
  Description of Artificial Sequence: Synthetic peptide
GGLLLSFRELKSNYFDY

SEQ ID NO: 917 - protein, 17 aa, Artificial Sequence
  Description of Artificial Sequence: Synthetic peptide
GGLLLTFRELKSNYFDY

SEQ ID NO: 918 - protein, 17 aa, Artificial Sequence
  Description of Artificial Sequence: Synthetic peptide
GGLLLVFRELKSNYFDY

SEQ ID NO: 919 - protein, 17 aa, Artificial Sequence
  Description of Artificial Sequence: Synthetic peptide
GGLLLWARELKSNYFDY

SEQ ID NO: 920 - protein, 17 aa, Artificial Sequence
  Description of Artificial Sequence: Synthetic peptide
GGLLLWCRELKSNYFDY

SEQ ID NO: 921 - protein, 17 aa, Artificial Sequence
  Description of Artificial Sequence: Synthetic peptide
GGLLLWDRELKSNYFDY

SEQ ID NO: 922 - protein, 17 aa, Artificial Sequence
  Description of Artificial Sequence: Synthetic peptide
GGLLLWERELKSNYFDY

SEQ ID NO: 923 - protein, 17 aa, Artificial Sequence
  Description of Artificial Sequence: Synthetic peptide
GGLLLWGRELKSNYFDY

SEQ ID NO: 924 - protein, 17 aa, Artificial Sequence
  Description of Artificial Sequence: Synthetic peptide
GGLLLWKRELKSNYFDY

SEQ ID NO: 925 - protein, 17 aa, Artificial Sequence
  Description of Artificial Sequence: Synthetic peptide
GGLLLWLRELKSNYFDY

SEQ ID NO: 926 - protein, 17 aa, Artificial Sequence
  Description of Artificial Sequence: Synthetic peptide
GGLLLWMRELKSNYFDY

SEQ ID NO: 927 - protein, 17 aa, Artificial Sequence
  Description of Artificial Sequence: Synthetic peptide
GGLLLWNRELKSNYFDY

SEQ ID NO: 928 - protein, 17 aa, Artificial Sequence
  Description of Artificial Sequence: Synthetic peptide
GGLLLWPRELKSNYFDY

SEQ ID NO: 929 - protein, 17 aa, Artificial Sequence
  Description of Artificial Sequence: Synthetic peptide
GGLLLWQRELKSNYFDY

SEQ ID NO: 930 - protein, 17 aa, Artificial Sequence
  Description of Artificial Sequence: Synthetic peptide
GGLLLWRRELKSNYFDY

SEQ ID NO: 931 - protein, 17 aa, Artificial Sequence
  Description of Artificial Sequence: Synthetic peptide
GGLLLWSRELKSNYFDY

SEQ ID NO: 932 - protein, 17 aa, Artificial Sequence
  Description of Artificial Sequence: Synthetic peptide
GGLLLWTRELKSNYFDY

SEQ ID NO: 933 - protein, 17 aa, Artificial Sequence
  Description of Artificial Sequence: Synthetic peptide
GGLLLWWRELKSNYFDY

SEQ ID NO: 934 - protein, 17 aa, Artificial Sequence
  Description of Artificial Sequence: Synthetic peptide
GGLLLWYRELKSNYFDY

SEQ ID NO: 935 - protein, 17 aa, Artificial Sequence
  Description of Artificial Sequence: Synthetic peptide
GGLLLWFAELKSNYFDY

SEQ ID NO: 936 - protein, 17 aa, Artificial Sequence
  Description of Artificial Sequence: Synthetic peptide
GGLLLWFCELKSNYFDY

SEQ ID NO: 937 - protein, 17 aa, Artificial Sequence
  Description of Artificial Sequence: Synthetic peptide
GGLLLWFEELKSNYFDY

SEQ ID NO: 938 - protein, 17 aa, Artificial Sequence
  Description of Artificial Sequence: Synthetic peptide
GGLLLWFFELKSNYFDY

SEQ ID NO: 939 - protein, 17 aa, Artificial Sequence
  Description of Artificial Sequence: Synthetic peptide
GGLLLWFGELKSNYFDY

SEQ ID NO: 940 - protein, 17 aa, Artificial Sequence
  Description of Artificial Sequence: Synthetic peptide
GGLLLWFHELKSNYFDY

SEQ ID NO: 941 - protein, 17 aa, Artificial Sequence
  Description of Artificial Sequence: Synthetic peptide
GGLLLWFKELKSNYFDY

SEQ ID NO: 942 - protein, 17 aa, Artificial Sequence
  Description of Artificial Sequence: Synthetic peptide
GGLLLWFLELKSNYFDY

SEQ ID NO: 943 - protein, 17 aa, Artificial Sequence
  Description of Artificial Sequence: Synthetic peptide
GGLLLWFMELKSNYFDY

SEQ ID NO: 944 - protein, 17 aa, Artificial Sequence
  Description of Artificial Sequence: Synthetic peptide
GGLLLWFPELKSNYFDY

SEQ ID NO: 945 - protein, 17 aa, Artificial Sequence
  Description of Artificial Sequence: Synthetic peptide
GGLLLWFQELKSNYFDY

SEQ ID NO: 946 - protein, 17 aa, Artificial Sequence
  Description of Artificial Sequence: Synthetic peptide
GGLLLWFSELKSNYFDY

SEQ ID NO: 947 - protein, 17 aa, Artificial Sequence
  Description of Artificial Sequence: Synthetic peptide
GGLLLWFTELKSNYFDY

SEQ ID NO: 948 - protein, 17 aa, Artificial Sequence
  Description of Artificial Sequence: Synthetic peptide
GGLLLWFVELKSNYFDY

SEQ ID NO: 949 - protein, 17 aa, Artificial Sequence
  Description of Artificial Sequence: Synthetic peptide
GGLLLWFWELKSNYFDY

SEQ ID NO: 950 - protein, 17 aa, Artificial Sequence
  Description of Artificial Sequence: Synthetic peptide
GGLLLWFYELKSNYFDY

SEQ ID NO: 951 - protein, 17 aa, Artificial Sequence
  Description of Artificial Sequence: Synthetic peptide
GGLLLWFRALKSNYFDY

SEQ ID NO: 952 - protein, 17 aa, Artificial Sequence
  Description of Artificial Sequence: Synthetic peptide
GGLLLWFRCLKSNYFDY

SEQ ID NO: 953 - protein, 17 aa, Artificial Sequence
  Description of Artificial Sequence: Synthetic peptide
GGLLLWFRGLKSNYFDY

SEQ ID NO: 954 - protein, 17 aa, Artificial Sequence
  Description of Artificial Sequence: Synthetic peptide
GGLLLWFRHLKSNYFDY

SEQ ID NO: 955 - protein, 17 aa, Artificial Sequence
  Description of Artificial Sequence: Synthetic peptide
GGLLLWFRKLKSNYFDY

SEQ ID NO: 956 - protein, 17 aa, Artificial Sequence
  Description of Artificial Sequence: Synthetic peptide
GGLLLWFRLLKSNYFDY

SEQ ID NO: 957 - protein, 17 aa, Artificial Sequence
  Description of Artificial Sequence: Synthetic peptide
GGLLLWFRNLKSNYFDY

SEQ ID NO: 958 - protein, 17 aa, Artificial Sequence
  Description of Artificial Sequence: Synthetic peptide
GGLLLWFRPLKSNYFDY

SEQ ID NO: 959 - protein, 17 aa, Artificial Sequence
  Description of Artificial Sequence: Synthetic peptide
GGLLLWFRQLKSNYFDY

SEQ ID NO: 960 - protein, 17 aa, Artificial Sequence
  Description of Artificial Sequence: Synthetic peptide
GGLLLWFRRLKSNYFDY

SEQ ID NO: 961 - protein, 17 aa, Artificial Sequence
  Description of Artificial Sequence: Synthetic peptide
GGLLLWFRSLKSNYFDY

SEQ ID NO: 962 - protein, 17 aa, Artificial Sequence
  Description of Artificial Sequence: Synthetic peptide
GGLLLWFRTLKSNYFDY

SEQ ID NO: 963 - protein, 17 aa, Artificial Sequence
  Description of Artificial Sequence: Synthetic peptide
GGLLLWFRVLKSNYFDY

SEQ ID NO: 964 - protein, 17 aa, Artificial Sequence
  Description of Artificial Sequence: Synthetic peptide
GGLLLWFRWLKSNYFDY

SEQ ID NO: 965 - protein, 17 aa, Artificial Sequence
  Description of Artificial Sequence: Synthetic peptide
GGLLLWFRYLKSNYFDY

SEQ ID NO: 966 - protein, 108 aa, Artificial Sequence; identical to SEQ ID NO: 265
  Description of Artificial Sequence: Synthetic polypeptide

SEQ ID NO: 967 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLAFRELKSNYFDYWGQGTLVTVSSASTKGPSVFPLAPSSKS

SEQ ID NO: 968 - protein, 108 aa, Artificial Sequence; identical to SEQ ID NO: 265
  Description of Artificial Sequence: Synthetic polypeptide

SEQ ID NO: 969 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLCFRELKSNYFDYWGQGTLVTVSSASTKGPSVFPLAPSSKS

SEQ ID NO: 970 - protein, 108 aa, Artificial Sequence; identical to SEQ ID NO: 265
  Description of Artificial Sequence: Synthetic polypeptide

SEQ ID NO: 971 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLDFRELKSNYFDYWGQGTLVTVSSASTKGPSVFPLAPSSKS

SEQ ID NO: 972 - protein, 108 aa, Artificial Sequence; identical to SEQ ID NO: 265
  Description of Artificial Sequence: Synthetic polypeptide

SEQ ID NO: 973 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLEFRELKSNYFDYWGQGTLVTVSSASTKGPSVFPLAPSSKS

SEQ ID NO: 974 - protein, 108 aa, Artificial Sequence; identical to SEQ ID NO: 265
  Description of Artificial Sequence: Synthetic polypeptide

SEQ ID NO: 975 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLGFRELKSNYFDYWGQGTLVTVSSASTKGPSVFPLAPSSKS

SEQ ID NO: 976 - protein, 108 aa, Artificial Sequence; identical to SEQ ID NO: 265
  Description of Artificial Sequence: Synthetic polypeptide

SEQ ID NO: 977 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLKFRELKSNYFDYWGQGTLVTVSSASTKGPSVFPLAPSSKS

SEQ ID NO: 978 - protein, 108 aa, Artificial Sequence; identical to SEQ ID NO: 265
  Description of Artificial Sequence: Synthetic polypeptide

SEQ ID NO: 979 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLLFRELKSNYFDYWGQGTLVTVSSASTKGPSVFPLAPSSKS

SEQ ID NO: 980 - protein, 108 aa, Artificial Sequence; identical to SEQ ID NO: 265
  Description of Artificial Sequence: Synthetic polypeptide

SEQ ID NO: 981 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLMFRELKSNYFDYWGQGTLVTVSSASTKGPSVFPLAPSSKS

SEQ ID NO: 982 - protein, 108 aa, Artificial Sequence; identical to SEQ ID NO: 265
  Description of Artificial Sequence: Synthetic polypeptide

SEQ ID NO: 983 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLPFRELKSNYFDYWGQGTLVTVSSASTKGPSVFPLAPSSKS

SEQ ID NO: 984 - protein, 108 aa, Artificial Sequence; identical to SEQ ID NO: 265
  Description of Artificial Sequence: Synthetic polypeptide

SEQ ID NO: 985 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLQFRELKSNYFDYWGQGTLVTVSSASTKGPSVFPLAPSSKS

SEQ ID NO: 986 - protein, 108 aa, Artificial Sequence; identical to SEQ ID NO: 265
  Description of Artificial Sequence: Synthetic polypeptide

SEQ ID NO: 987 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLRFRELKSNYFDYWGQGTLVTVSSASTKGPSVFPLAPSSKS

SEQ ID NO: 988 - protein, 108 aa, Artificial Sequence; identical to SEQ ID NO: 265
  Description of Artificial Sequence: Synthetic polypeptide

SEQ ID NO: 989 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNILYLQMNSLRAEDTAVYYCARGGLLLSFRELKSNYFDYWGQGTLVTVSSASTKGPSVFPLAPSSKS

SEQ ID NO: 990 - protein, 108 aa, Artificial Sequence; identical to SEQ ID NO: 265
  Description of Artificial Sequence: Synthetic polypeptide

SEQ ID NO: 991 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLTFRELKSNYFDYWGQGTLVTVSSASTKGPSVFPLAPSSKS

SEQ ID NO: 992 - protein, 108 aa, Artificial Sequence; identical to SEQ ID NO: 265
  Description of Artificial Sequence: Synthetic polypeptide

SEQ ID NO: 993 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLVFRELKSNYFDYWGQGTLVTVSSASTKGPSVFPLAPSSKS

SEQ ID NO: 994 - protein, 108 aa, Artificial Sequence; identical to SEQ ID NO: 265
  Description of Artificial Sequence: Synthetic polypeptide

SEQ ID NO: 995 - protein, 143 aa, Artificial Sequence; identical to SEQ ID NO: 296
  Description of Artificial Sequence: Synthetic polypeptide

SEQ ID NO: 996 - protein, 108 aa, Artificial Sequence; identical to SEQ ID NO: 265
  Description of Artificial Sequence: Synthetic polypeptide

SEQ ID NO: 997 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWCRELKSNYFDYWGQGTLVTVSSASTKGPSVFPLAPSSKS

SEQ ID NO: 998 - protein, 108 aa, Artificial Sequence; identical to SEQ ID NO: 265
  Description of Artificial Sequence: Synthetic polypeptide

SEQ ID NO: 999 - protein, 143 aa, Artificial Sequence; identical to SEQ ID NO: 290
  Description of Artificial Sequence: Synthetic polypeptide

SEQ ID NO: 1000 - protein, 108 aa, Artificial Sequence; identical to SEQ ID NO: 265
  Description of Artificial Sequence: Synthetic polypeptide

SEQ ID NO: 1001 - protein, 143 aa, Artificial Sequence; identical to SEQ ID NO: 298
  Description of Artificial Sequence: Synthetic polypeptide

SEQ ID NO: 1002 - protein, 108 aa, Artificial Sequence; identical to SEQ ID NO: 265
  Description of Artificial Sequence: Synthetic polypeptide

SEQ ID NO: 1003 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFAELKSNYFDYWGQGTLVTVSSASTKGPSVFPLAPSSKS

SEQ ID NO: 1004 - protein, 108 aa, Artificial Sequence; identical to SEQ ID NO: 265
  Description of Artificial Sequence: Synthetic polypeptide

SEQ ID NO: 1005 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFCELKSNYFDYWGQGTLVTVSSASTKGPSVFPLAPSSKS

SEQ ID NO: 1006 - protein, 108 aa, Artificial Sequence; identical to SEQ ID NO: 265
  Description of Artificial Sequence: Synthetic polypeptide

SEQ ID NO: 1007 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFEELKSNYFDYWGQGTLVTVSSASTKGPSVFPLAPSSKS

SEQ ID NO: 1008 - protein, 108 aa, Artificial Sequence; identical to SEQ ID NO: 265
  Description of Artificial Sequence: Synthetic polypeptide

SEQ ID NO: 1009 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFFELKSNYFDYWGQGTLVTVSSASTKGPSVFPLAPSSKS

SEQ ID NO: 1010 - protein, 108 aa, Artificial Sequence; identical to SEQ ID NO: 265
  Description of Artificial Sequence: Synthetic polypeptide

SEQ ID NO: 1011 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMHSLRAEDTAVYYCARGGLLLWFGELKSNYFDYWGQGTLVTVSSASTKGPSVFPLAPSSKS

SEQ ID NO: 1012 - protein, 108 aa, Artificial Sequence; identical to SEQ ID NO: 265
  Description of Artificial Sequence: Synthetic polypeptide

SEQ ID NO: 1013 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFHELKSNYFDYWGQGTLVTVSSASTKGPSVFPLAPSSKS

SEQ ID NO: 1014 - protein, 108 aa, Artificial Sequence; identical to SEQ ID NO: 265
  Description of Artificial Sequence: Synthetic polypeptide

SEQ ID NO: 1015 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFKELKSNYFDYWGQGTLVTVSSASTKGPSVFPLAPSSKS

SEQ ID NO: 1016 - protein, 108 aa, Artificial Sequence; identical to SEQ ID NO: 265
  Description of Artificial Sequence: Synthetic polypeptide

SEQ ID NO: 1017 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFLELKSNYFDYWGQGTLVTVSSASTKGPSVFPLAPSSKS

SEQ ID NO: 1018 - protein, 108 aa, Artificial Sequence; identical to SEQ ID NO: 265
  Description of Artificial Sequence: Synthetic polypeptide

SEQ ID NO: 1019 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFMELKSNYFDYWGQGTLVTVSSASTKGPSVFPLAPSSKS

SEQ ID NO: 1020 - protein, 108 aa, Artificial Sequence; identical to SEQ ID NO: 265
  Description of Artificial Sequence: Synthetic polypeptide

SEQ ID NO: 1021 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFPELKSNYFDYWGQGTLVTVSSASTKGPSVFPLAPSSKS

SEQ ID NO: 1022 - protein, 108 aa, Artificial Sequence; identical to SEQ ID NO: 265
  Description of Artificial Sequence: Synthetic polypeptide

SEQ ID NO: 1023 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFQELKSNYFDYWGQGTLVTVSSASTKGPSVFPLAPSSKS

SEQ ID NO: 1024 - protein, 108 aa, Artificial Sequence; identical to SEQ ID NO: 265
  Description of Artificial Sequence: Synthetic polypeptide

SEQ ID NO: 1025 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRALKSNYFDYWGQGTLVTVSSASTKGPSVFPLAPSSKS

SEQ ID NO: 1026 - protein, 108 aa, Artificial Sequence; identical to SEQ ID NO: 265
  Description of Artificial Sequence: Synthetic polypeptide

SEQ ID NO: 1027 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRCLKSNYFDYWGQGTLVTVSSASTKGPSVFPLAPSSKS

SEQ ID NO: 1028 - protein, 108 aa, Artificial Sequence; identical to SEQ ID NO: 265
  Description of Artificial Sequence: Synthetic polypeptide

SEQ ID NO: 1029 - protein, 143 aa, Artificial Sequence; identical to SEQ ID NO: 266
  Description of Artificial Sequence: Synthetic polypeptide

SEQ ID NO: 1030 - protein, 108 aa, Artificial Sequence; identical to SEQ ID NO: 265
  Description of Artificial Sequence: Synthetic polypeptide

SEQ ID NO: 1031 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRGLKSNYFDYWGQGTLVTVSSASTKGPSVFPLAPSSKS

SEQ ID NO: 1032 - protein, 108 aa, Artificial Sequence; identical to SEQ ID NO: 265
  Description of Artificial Sequence: Synthetic polypeptide

SEQ ID NO: 1033 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRHLKSNYFDYWGQGTLVTVSSASTKGPSVFPLAPSSKS

SEQ ID NO: 1034 - protein, 108 aa, Artificial Sequence; identical to SEQ ID NO: 265
  Description of Artificial Sequence: Synthetic polypeptide

SEQ ID NO: 1035 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRKLKSNYFDYWGQGTLVTVSSASTKGPSVFPLAPSSKS

SEQ ID NO: 1036 - protein, 108 aa, Artificial Sequence; identical to SEQ ID NO: 265
  Description of Artificial Sequence: Synthetic polypeptide

SEQ ID NO: 1037 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRLLKSNYFDYWGQGTLVTVSSASTKGPSVFPLAPSSKS

SEQ ID NO: 1038 - protein, 108 aa, Artificial Sequence; identical to SEQ ID NO: 265
  Description of Artificial Sequence: Synthetic polypeptide

SEQ ID NO: 1039 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRNLKSNYFDYWGQGTLVTVSSASTKGPSVFPLAPSSKS

SEQ ID NO: 1040 - protein, 108 aa, Artificial Sequence; identical to SEQ ID NO: 265
  Description of Artificial Sequence: Synthetic polypeptide

SEQ ID NO: 1041 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRPLKSNYFDYWGQGTLVTVSSASTKGPSVFPLAPSSKS

SEQ ID NO: 1042 - protein, 108 aa, Artificial Sequence; identical to SEQ ID NO: 265
  Description of Artificial Sequence: Synthetic polypeptide

SEQ ID NO: 1043 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRQLKSNYFDYWGQGTLVTVSSASTKGPSVFPLAPSSKS

SEQ ID NO: 1044 - protein, 108 aa, Artificial Sequence; identical to SEQ ID NO: 265
  Description of Artificial Sequence: Synthetic polypeptide

SEQ ID NO: 1045 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRRLKSNYFDYWGQGTLVTVSSASTKGPSVFPLAPSSKS

SEQ ID NO: 1046 - protein, 108 aa, Artificial Sequence; identical to SEQ ID NO: 265
  Description of Artificial Sequence: Synthetic polypeptide

SEQ ID NO: 1047 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRSLKSNYFDYWGQGTLVTVSSASTKGPSVFPLAPSSKS

SEQ ID NO: 1048 - protein, 108 aa, Artificial Sequence; identical to SEQ ID NO: 265
  Description of Artificial Sequence: Synthetic polypeptide

SEQ ID NO: 1049 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRTLKSNYFDYWGQGTLVTVSSASTKGPSVFPLAPSSKS

SEQ ID NO: 1050 - protein, 108 aa, Artificial Sequence; identical to SEQ ID NO: 265
  Description of Artificial Sequence: Synthetic polypeptide

SEQ ID NO: 1051 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRVLKSNYFDYWGQGTLVTVSSASTKGPSVFPLAPSSKS

SEQ ID NO: 1052 - protein, 108 aa, Artificial Sequence; identical to SEQ ID NO: 265
  Description of Artificial Sequence: Synthetic polypeptide

SEQ ID NO: 1053 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRWLKSNYFDYWGQGTLVTVSSASTKGPSVFPLAPSSKS

SEQ ID NO: 1054 - protein, 108 aa, Artificial Sequence; identical to SEQ ID NO: 265
  Description of Artificial Sequence: Synthetic polypeptide

SEQ ID NO: 1055 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFRYLKSNYFDYWGQGTLVTVSSASTKGPSVFPLAPSSKS

SEQ ID NO: 1056 - protein, 108 aa, Artificial Sequence; identical to SEQ ID NO: 265
  Description of Artificial Sequence: Synthetic polypeptide

SEQ ID NO: 1057 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFSELKSNYFDYWGQGTLVTVSSASTKGPSVFPLAPSSKS

SEQ ID NO: 1058 - protein, 108 aa, Artificial Sequence; identical to SEQ ID NO: 265
  Description of Artificial Sequence: Synthetic polypeptide

SEQ ID NO: 1059 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFTELKSNYFDYWGQGTLVTVSSASTKGPSVFPLAPSSKS

SEQ ID NO: 1060 - protein, 108 aa, Artificial Sequence; identical to SEQ ID NO: 265
  Description of Artificial Sequence: Synthetic polypeptide

SEQ ID NO: 1061 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFVELKSNYFDYWGQGTLVTVSSASTKGPSVFPLAPSSKS

SEQ ID NO: 1062 - protein, 108 aa, Artificial Sequence; identical to SEQ ID NO: 265
  Description of Artificial Sequence: Synthetic polypeptide

SEQ ID NO: 1063 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFWELKSNYFDYWGQGTLVTVSSASTKGPSVFPLAPSSKS

SEQ ID NO: 1064 - protein, 108 aa, Artificial Sequence; identical to SEQ ID NO: 265
  Description of Artificial Sequence: Synthetic polypeptide

SEQ ID NO: 1065 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWFYELKSNYFDYWGQGTLVTVSSASTKGPSVFPLAPSSKS

SEQ ID NO: 1066 - protein, 108 aa, Artificial Sequence; identical to SEQ ID NO: 265
  Description of Artificial Sequence: Synthetic polypeptide

SEQ ID NO: 1067 - protein, 143 aa, Artificial Sequence; identical to SEQ ID NO: 286
  Description of Artificial Sequence: Synthetic polypeptide

SEQ ID NO: 1068 - protein, 108 aa, Artificial Sequence; identical to SEQ ID NO: 265
  Description of Artificial Sequence: Synthetic polypeptide

SEQ ID NO: 1069 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWKRELKSNYFDYWGQGTLVTVSSASTKGPSVFPLAPSSKS

SEQ ID NO: 1070 - protein, 108 aa, Artificial Sequence; identical to SEQ ID NO: 265
  Description of Artificial Sequence: Synthetic polypeptide

SEQ ID NO: 1071 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWLRELKSNYFDYWGQGTLVTVSSASTKGPSVFPLAPSSKS

SEQ ID NO: 1072 - protein, 108 aa, Artificial Sequence; identical to SEQ ID NO: 265
  Description of Artificial Sequence: Synthetic polypeptide

SEQ ID NO: 1073 - protein, 143 aa, Artificial Sequence; identical to SEQ ID NO: 284
  Description of Artificial Sequence: Synthetic polypeptide

SEQ ID NO: 1074 - protein, 108 aa, Artificial Sequence; identical to SEQ ID NO: 265
  Description of Artificial Sequence: Synthetic polypeptide

SEQ ID NO: 1075 - protein, 143 aa, Artificial Sequence; identical to SEQ ID NO: 288
  Description of Artificial Sequence: Synthetic polypeptide

SEQ ID NO: 1076 - protein, 108 aa, Artificial Sequence; identical to SEQ ID NO: 265
  Description of Artificial Sequence: Synthetic polypeptide

SEQ ID NO: 1077 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWPRELKSNYFDYWGQGTLVTVSSASTKGPSVFPLAPSSKS

SEQ ID NO: 1078 - protein, 108 aa, Artificial Sequence; identical to SEQ ID NO: 265
  Description of Artificial Sequence: Synthetic polypeptide

SEQ ID NO: 1079 - protein, 143 aa, Artificial Sequence; identical to SEQ ID NO: 292
  Description of Artificial Sequence: Synthetic polypeptide

SEQ ID NO: 1080 - protein, 108 aa, Artificial Sequence; identical to SEQ ID NO: 265
  Description of Artificial Sequence: Synthetic polypeptide

SEQ ID NO: 1081 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWRRELKSNYFDYWGQGTLVTVSSASTKGPSVFPLAPSSKS

SEQ ID NO: 1082 - protein, 108 aa, Artificial Sequence; identical to SEQ ID NO: 265
  Description of Artificial Sequence: Synthetic polypeptide

SEQ ID NO: 1083 - protein, 143 aa, Artificial Sequence; identical to SEQ ID NO: 282
  Description of Artificial Sequence: Synthetic polypeptide

SEQ ID NO: 1084 - protein, 108 aa, Artificial Sequence; identical to SEQ ID NO: 265
  Description of Artificial Sequence: Synthetic polypeptide

SEQ ID NO: 1085 - protein, 143 aa, Artificial Sequence; identical to SEQ ID NO: 294
  Description of Artificial Sequence: Synthetic polypeptide

SEQ ID NO: 1086 - protein, 108 aa, Artificial Sequence; identical to SEQ ID NO: 265
  Description of Artificial Sequence: Synthetic polypeptide

SEQ ID NO: 1087 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWWRELKSNYFDYWGQGTLVTVSSASTKGPSVFPLAPSSKS

SEQ ID NO: 1088 - protein, 108 aa, Artificial Sequence; identical to SEQ ID NO: 265
  Description of Artificial Sequence: Synthetic polypeptide

SEQ ID NO: 1089 - protein, 143 aa, Artificial Sequence
  Description of Artificial Sequence: Synthetic polypeptide
EVQLLESGGGLVQPGGSLRLSCAASGFTFSAYSMIWVRQAPGKGLEWVSYIRPSGGRTTYADSVKGRFTISRDNSKNTLYLQMNSLRAEDTAVYYCARGGLLLWYRELKSNYFDYWGQGTLVTVSSASTKGPSVFPLAPSSKS

SEQ ID NO: 1090 - protein, 11 aa, Artificial Sequence
  Description of Artificial Sequence: Synthetic peptide
RASQPIDNYLN

SEQ ID NO: 1091 - protein, 7 aa, Artificial Sequence
  Description of Artificial Sequence: Synthetic peptide
AASRLQS

SEQ ID NO: 1092 - protein, 9 aa, Artificial Sequence
  Description of Artificial Sequence: Synthetic peptide
QQSYTVPYT

SEQ ID NO: 1093 - protein, 5 aa, Artificial Sequence
  Description of Artificial Sequence: Synthetic peptide
AYSMI

SEQ ID NO: 1094 - protein, 17 aa, Artificial Sequence
  Description of Artificial Sequence: Synthetic peptide
YIRPSGGRTTYADSVKG

SEQ ID NO: 1095 - protein, 17 aa, Artificial Sequence
  Description of Artificial Sequence: Synthetic peptide
GGLLLWNRELKSNYFDY

SEQ ID NO: 1096 - protein, 11 aa, Artificial Sequence
  Description of Artificial Sequence: Synthetic peptide
RASQPIDNYLN

SEQ ID NO: 1097 - protein, 7 aa, Artificial Sequence
  Description of Artificial Sequence: Synthetic peptide
AASRLQS

SEQ ID NO: 1098 - protein, 9 aa, Artificial Sequence
  Description of Artificial Sequence: Synthetic peptide
QQSYTVPYT

SEQ ID NO: 1099 - protein, 5 aa, Artificial Sequence
  Description of Artificial Sequence: Synthetic peptide
AYSMI

SEQ ID NO: 1100 - protein, 17 aa, Artificial Sequence
  Description of Artificial Sequence: Synthetic peptide
YIRPSGGRTTYADSVKG

SEQ ID NO: 1101 - protein, 17 aa, Artificial Sequence
  Description of Artificial Sequence: Synthetic peptide
GGLLLWARELKSNYFDY

SEQ ID NO: 1102 - protein, 11 aa, Artificial Sequence
  Description of Artificial Sequence: Synthetic peptide
RAGRSISTYVN

SEQ ID NO: 1103 - protein, 7 aa, Artificial Sequence
  Description of Artificial Sequence: Synthetic peptide
AASSLQS

SEQ ID NO: 1104 - protein, 9 aa, Artificial Sequence
  Description of Artificial Sequence: Synthetic peptide
QQSQSTPYT

SEQ ID NO: 1105 - protein, 5 aa, Artificial Sequence
  Description of Artificial Sequence: Synthetic peptide
HYLMT

SEQ ID NO: 1106 - protein, 17 aa, Artificial Sequence
  Description of Artificial Sequence: Synthetic peptide
YISPSGGHTIYADSVKG

SEQ ID NO: 1107 - protein, 16 aa, Artificial Sequence
  Description of Artificial Sequence: Synthetic peptide
VARGIAARSRTSYFDY

SEQ ID NO: 1108 - protein, 12 aa, Artificial Sequence
  Description of Artificial Sequence: Synthetic peptide
RASQIVSSRYLA

SEQ ID NO: 1109 - protein, 7 aa, Artificial Sequence
  Description of Artificial Sequence: Synthetic peptide
GAASRAT

SEQ ID NO: 1110 - protein, 9 aa, Artificial Sequence
  Description of Artificial Sequence: Synthetic peptide
QQTYSSPFT

SEQ ID NO: 1111 - protein, 5 aa, Artificial Sequence
  Description of Artificial Sequence: Synthetic peptide
HYLMT

SEQ ID NO: 1112 - protein, 17 aa, Artificial Sequence
  Description of Artificial Sequence: Synthetic peptide
YISPSGGHTIYADSVKG

SEQ ID NO: 1113 - protein, 16 aa, Artificial Sequence
  Description of Artificial Sequence: Synthetic peptide
VARGIAARSRTSYFDY

SEQ ID NO: 1114 - protein, 11 aa, Artificial Sequence
  Description of Artificial Sequence: Synthetic peptide
RASQSISNYLN

SEQ ID NO: 1115 - protein, 7 aa, Artificial Sequence
  Description of Artificial Sequence: Synthetic peptide
AASSLQS

SEQ ID NO: 1116 - protein, 9 aa, Artificial Sequence
  Description of Artificial Sequence: Synthetic peptide
QQSYTSPYT

SEQ ID NO: 1117 - protein, 5 aa, Artificial Sequence
  Description of Artificial Sequence: Synthetic peptide
HYLMT

SEQ ID NO: 1118 - protein, 17 aa, Artificial Sequence
  Description of Artificial Sequence: Synthetic peptide
YISPSGGHTIYADSVKG

SEQ ID NO: 1119 - protein, 16 aa, Artificial Sequence
  Description of Artificial Sequence: Synthetic peptide
VARGIAARSRTSYFDY

SEQ ID NO: 1120 - protein, 12 aa, Artificial Sequence
  Description of Artificial Sequence: Synthetic peptide
RASQIVSSNYLA

SEQ ID NO: 1121 - protein, 7 aa, Artificial Sequence
  Description of Artificial Sequence: Synthetic peptide
GASNRAT

SEQ ID NO: 1122 - protein, 9 aa, Artificial Sequence
  Description of Artificial Sequence: Synthetic peptide
QQSFNIPYT

SEQ ID NO: 1123 - protein, 5 aa, Artificial Sequence
  Description of Artificial Sequence: Synthetic peptide
HYLMT

SEQ ID NO: 1124 - protein, 17 aa, Artificial Sequence
  Description of Artificial Sequence: Synthetic peptide
YISPSGGHTIYADSVKG

SEQ ID NO: 1125 - protein, 16 aa, Artificial Sequence
  Description of Artificial Sequence: Synthetic peptide
VARGIAARSRTSYFDY

SEQ ID NO: 1126 - protein, 12 aa, Artificial Sequence
  Description of Artificial Sequence: Synthetic peptide
RTSQFVNSNYLA

SEQ ID NO: 1127 - protein, 7 aa, Artificial Sequence
  Description of Artificial Sequence: Synthetic peptide
GASSRAT

SEQ ID NO: 1128 - protein, 9 aa, Artificial Sequence
  Description of Artificial Sequence: Synthetic peptide
QQSSRTPWT

SEQ ID NO: 1129 - protein, 5 aa, Artificial Sequence
  Description of Artificial Sequence: Synthetic peptide
HYLMT

SEQ ID NO: 1130 - protein, 17 aa, Artificial Sequence
  Description of Artificial Sequence: Synthetic peptide
YISPSGGHTIYADSVKG

SEQ ID NO: 1131 - protein, 16 aa, Artificial Sequence
  Description of Artificial Sequence: Synthetic peptide
VARGIAARSRTSYFDY

SEQ ID NO: 1132 - protein, 12 aa, Artificial Sequence
  Description of Artificial Sequence: Synthetic peptide
RTSQFVNSNYLA

SEQ ID NO: 1133 - protein, 7 aa, Artificial Sequence
  Description of Artificial Sequence: Synthetic peptide
GASSRAT

SEQ ID NO: 1134 - protein, 9 aa, Artificial Sequence
  Description of Artificial Sequence: Synthetic peptide
QQSSRTPWT

SEQ ID NO: 1135 - protein, 5 aa, Artificial Sequence
  Description of Artificial Sequence: Synthetic peptide
HYLMT

SEQ ID NO: 1136 - protein, 17 aa, Artificial Sequence
  Description of Artificial Sequence: Synthetic peptide
YISPSGGHTIYADSVKG

SEQ ID NO: 1137 - protein, 16 aa, Artificial Sequence
  Description of Artificial Sequence: Synthetic peptide
VARGIAARSRTSYFDY

SEQ ID NO: 1138 - protein, 108 aa, Artificial Sequence
  Description of Artificial Sequence: Synthetic polypeptide
QDIQMTQSPSSLSASVGDRVTVTCRAGRSISTYVNWYQQKPGKAPKLLIYAASSLQSGVPSRFSGSRSGTDFTLTISSLQPEDFATYYCQQSQSTPYTFGQGTKLEVK

SEQ ID NO: 1139 - protein, 142 aa, Artificial Sequence; identical to SEQ ID NO: 276
  Description of Artificial Sequence: Synthetic polypeptide

SEQ ID NO: 1140 - protein, 109 aa, Artificial Sequence
  Description of Artificial Sequence: Synthetic polypeptide
QDIQMTQSPGTLSLSPGERATLSCRASQIVSSRYLAWYQQRPGQAPRLLIYGAASRATGIPDRFSGSGSGTDFTLTISSLQAEDFATYYCQQTYSSPFTFGQGTKMEIK

SEQ ID NO: 1141 - protein, 142 aa, Artificial Sequence; identical to SEQ ID NO: 276
  Description of Artificial Sequence: Synthetic polypeptide

SEQ ID NO: 1142 - protein, 109 aa, Artificial Sequence
  Description of Artificial Sequence: Synthetic polypeptide
QDIQMTQSPGTLSLSPGERATLSCRTSQFVNSNYLAWYQQTPGQAPRLLIYGASSRATGIPDRFSGTGYGTDFTLTISRLEPEDYGTYYCQQSSRTPWTFGQGTRVEIK

SEQ ID NO: 1143 - protein, 142 aa, Artificial Sequence; identical to SEQ ID NO: 276
  Description of Artificial Sequence: Synthetic polypeptide

SEQ ID NO: 1144 - protein, 110 aa, Artificial Sequence
  Description of Artificial Sequence: Synthetic polypeptide
QDIQMTQSPDSLSASVGDRVTITCRASQSISNYLNWYQQKPGKAPKLLIYAASSLQSGVPSRFSGSGSGTDFTLTISGLQPEDFASYYCQQSYTSPYTFVQGTKLEIKRT

SEQ ID NO: 1145 - protein, 142 aa, Artificial Sequence; identical to SEQ ID NO: 276
  Description of Artificial Sequence: Synthetic polypeptide

SEQ ID NO: 1146 - protein, 109 aa, Artificial Sequence
  Description of Artificial Sequence: Synthetic polypeptide
QDIQMTQSPATLSLSPGERATLSCRASQIVSSNYLAWYQQKPGQAPRLLIYGASNRATGIPDRFSGSGSGTEFTLTISSLQSEDFAIYYCQQSFNIPYTFGQGTRVDIK

SEQ ID NO: 1147 - protein, 142 aa, Artificial Sequence; identical to SEQ ID NO: 276
  Description of Artificial Sequence: Synthetic polypeptide

SEQ ID NO: 1148 - protein, 11 aa, Artificial Sequence
  Description of Artificial Sequence: Synthetic peptide
RASQSISSWLA

SEQ ID NO: 1149 - protein, 7 aa, Artificial Sequence
  Description of Artificial Sequence: Synthetic peptide
KASTLES

SEQ ID NO: 1150 - protein, 8 aa, Artificial Sequence
  Description of Artificial Sequence: Synthetic peptide
QQYNTYWT

SEQ ID NO: 1151 - protein, 5 aa, Artificial Sequence
  Description of Artificial Sequence: Synthetic peptide
HYIMM

SEQ ID NO: 1152 - protein, 17 aa, Artificial Sequence
  Description of Artificial Sequence: Synthetic peptide
GIYSSGGITVYADSVKG

SEQ ID NO: 1153 - protein, 13 aa, Artificial Sequence
  Description of Artificial Sequence: Synthetic peptide
QRTGVPRRDSFNI

SEQ ID NO: 1154 - protein, 11 aa, Artificial Sequence
  Description of Artificial Sequence: Synthetic peptide
RASQSISSWLA

SEQ ID NO: 1155 - protein, 7 aa, Artificial Sequence
  Description of Artificial Sequence: Synthetic peptide
KASTLES

SEQ ID NO: 1156 - protein, 8 aa, Artificial Sequence
  Description of Artificial Sequence: Synthetic peptide
QQYNTYWT

SEQ ID NO: 1157 - protein, 5 aa, Artificial Sequence
  Description of Artificial Sequence: Synthetic peptide
IYSMH

SEQ ID NO: 1158 - protein, 17 aa, Artificial Sequence
  Description of Artificial Sequence: Synthetic peptide
SIYPSRGMTWYADSVKG

SEQ ID NO: 1159 - protein, 13 aa, Artificial Sequence
  Description of Artificial Sequence: Synthetic peptide
RRTGIPRRDAFDI

SEQ ID NO: 1160 - protein, 11 aa, Artificial Sequence
  Description of Artificial Sequence: Synthetic peptide
RASQSISSWLA

SEQ ID NO: 1161 - protein, 7 aa, Artificial Sequence
  Description of Artificial Sequence: Synthetic peptide
KASTLES

SEQ ID NO: 1162 - protein, 8 aa, Artificial Sequence
  Description of Artificial Sequence: Synthetic peptide
QQYNTYWT

SEQ ID NO: 1163 - protein, 5 aa, Artificial Sequence
  Description of Artificial Sequence: Synthetic peptide
VYNMH

SEQ ID NO: 1164 - protein, 17 aa, Artificial Sequence
  Description of Artificial Sequence: Synthetic peptide
SIYPSGGMTYYADSVKG

SEQ ID NO: 1165 - protein, 13 aa, Artificial Sequence
  Description of Artificial Sequence: Synthetic peptide
RRTGIPRRDAFDI

SEQ ID NO: 1166 - protein, 11 aa, Artificial Sequence
  Description of Artificial Sequence: Synthetic peptide
RASQSISSWLA

SEQ ID NO: 1167 - protein, 7 aa, Artificial Sequence
  Description of Artificial Sequence: Synthetic peptide
KASTLES

SEQ ID NO: 1168 - protein, 8 aa, Artificial Sequence
  Description of Artificial Sequence: Synthetic peptide
QQYNTYWT

SEQ ID NO: 1169 - protein, 5 aa, Artificial Sequence
  Description of Artificial Sequence: Synthetic peptide
HYIMM

SEQ ID NO: 1170 - protein, 17 aa, Artificial Sequence
  Description of Artificial Sequence: Synthetic peptide
GIYSSGGITVYADSVKG

SEQ ID NO: 1171 - protein, 13 aa, Artificial Sequence
  Description of Artificial Sequence: Synthetic peptide
RRIGVPRRDEFDI

SEQ ID NO: 1172 - protein, 11 aa, Artificial Sequence
  Description of Artificial Sequence: Synthetic peptide
RASQSISSWLA

SEQ ID NO: 1173 - protein, 7 aa, Artificial Sequence
  Description of Artificial Sequence: Synthetic peptide
KASTLES

SEQ ID NO: 1174 - protein, 8 aa, Artificial Sequence
  Description of Artificial Sequence: Synthetic peptide
QQYNTYWT

SEQ ID NO: 1175 - protein, 5 aa, Artificial Sequence
  Description of Artificial Sequence: Synthetic peptide
HYIMM

SEQ ID NO: 1176 - protein, 17 aa, Artificial Sequence
  Description of Artificial Sequence: Synthetic peptide
GIYSSGGITVYADSVKG

SEQ ID NO: 1177 - protein, 13 aa, Artificial Sequence
  Description of Artificial Sequence: Synthetic peptide
RRTGVPRWDDFDI

SEQ ID NO: 1178 - protein, 11 aa, Artificial Sequence
  Description of Artificial Sequence: Synthetic peptide
RASQSISSWLA

SEQ ID NO: 1179 - protein, 7 aa, Artificial Sequence
  Description of Artificial Sequence: Synthetic peptide
KASTLES

SEQ ID NO: 1180 - protein, 8 aa, Artificial Sequence
  Description of Artificial Sequence: Synthetic peptide
QQYNTYWT

SEQ ID NO: 1181 - protein, 5 aa, Artificial Sequence
  Description of Artificial Sequence: Synthetic peptide
IYSMH

SEQ ID NO: 1182 - protein, 17 aa, Artificial Sequence
  Description of Artificial Sequence: Synthetic peptide
SIYSSGGPTKYADSVKG

SEQ ID NO: 1183 - protein, 13 aa, Artificial Sequence
  Description of Artificial Sequence: Synthetic peptide
RRTGIPRRDAFDI

SEQ ID NO: 1184 - protein, 11 aa, Artificial Sequence
  Description of Artificial Sequence: Synthetic peptide
RASQSISSWLA

SEQ ID NO: 1185 - protein, 7 aa, Artificial Sequence
  Description of Artificial Sequence: Synthetic peptide
KASTLES

SEQ ID NO: 1186 - protein, 8 aa, Artificial Sequence
  Description of Artificial Sequence: Synthetic peptide
QQYNTYWT

SEQ ID NO: 1187 - protein, 5 aa, Artificial Sequence
  Description of Artificial Sequence: Synthetic peptide
HYIMM

SEQ ID NO: 1188 - protein, 17 aa, Artificial Sequence
  Description of Artificial Sequence: Synthetic peptide
GIYSSGGITVYADSVKG

SEQ ID NO: 1189 - protein, 13 aa, Artificial Sequence
  Description of Artificial Sequence: Synthetic peptide
RRIGVPRRDSFDM

SEQ ID NO: 1190 - protein, 11 aa, Artificial Sequence
  Description of Artificial Sequence: Synthetic peptide
RASQSISSWLA

SEQ ID NO: 1191 - protein, 7 aa, Artificial Sequence
  Description of Artificial Sequence: Synthetic peptide
KASTLES

SEQ ID NO: 1192 - protein, 8 aa, Artificial Sequence
  Description of Artificial Sequence: Synthetic peptide
QQYNTYWT

SEQ ID NO: 1193 - protein, 5 aa, Artificial Sequence
  Description of Artificial Sequence: Synthetic peptide
HYIMM

SEQ ID NO: 1194 - protein, 17 aa, Artificial Sequence
  Description of Artificial Sequence: Synthetic peptide
GIYSSGGITVYADSVKG

SEQ ID NO: 1195 - protein, 13 aa, Artificial Sequence
  Description of Artificial Sequence: Synthetic peptide
RRTGVPRWDDFDI

SEQ ID NO: 1196 - protein, 11 aa, Artificial Sequence
  Description of Artificial Sequence: Synthetic peptide
RASQSISSWLA

SEQ ID NO: 1197 - protein, 7 aa, Artificial Sequence
  Description of Artificial Sequence: Synthetic peptide
KASTLES

SEQ ID NO: 1198 - protein, 8 aa, Artificial Sequence
  Description of Artificial Sequence: Synthetic peptide
QQYNTYWT

SEQ ID NO: 1199 - protein, 5 aa, Artificial Sequence
  Description of Artificial Sequence: Synthetic peptide
HYIMM

SEQ ID NO: 1200 - protein, 17 aa, Artificial Sequence
  Description of Artificial Sequence: Synthetic peptide
GIYSSGGITVYADSVKG

SEQ ID NO: 1201 - protein, 13 aa, Artificial Sequence
  Description of Artificial Sequence: Synthetic peptide
RRTGVPRRDEFDI

SEQ ID NO: 1202 - protein, 11 aa, Artificial Sequence
  Description of Artificial Sequence: Synthetic peptide
RASQSISSWLA

SEQ ID NO: 1203 - protein, 7 aa, Artificial Sequence
  Description of Artificial Sequence: Synthetic peptide
KASTLES

SEQ ID NO: 1204 - protein, 8 aa, Artificial Sequence
  Description of Artificial Sequence: Synthetic peptide
QQYNTYWT

SEQ ID NO: 1205 - protein, 5 aa, Artificial Sequence
  Description of Artificial Sequence: Synthetic peptide
IYDMI

SEQ ID NO: 1206 - protein, 17 aa, Artificial Sequence
  Description of Artificial Sequence: Synthetic peptide
SIYPSGGNTSYADSVKG

SEQ ID NO: 1207 - protein, 13 aa, Artificial Sequence
  Description of Artificial Sequence: Synthetic peptide
RRTGIPRRDAFDI

SEQ ID NO: 1208 - protein, 11 aa, Artificial Sequence
  Description of Artificial Sequence: Synthetic peptide
RASQSISSWLA

SEQ ID NO: 1209 - protein, 7 aa, Artificial Sequence
  Description of Artificial Sequence: Synthetic peptide
KASTLES

SEQ ID NO: 1210 - protein, 8 aa, Artificial Sequence
  Description of Artificial Sequence: Synthetic peptide
QQYNTYWT

SEQ ID NO: 1211 - protein, 5 aa, Artificial Sequence
  Description of Artificial Sequence: Synthetic peptide
HYIMM

SEQ ID NO: 1212 - protein, 17 aa, Artificial Sequence
  Description of Artificial Sequence: Synthetic peptide
GIYSSGGITVYADSVKG

SEQ ID NO: 1213 - protein, 13 aa, Artificial Sequence
  Description of Artificial Sequence: Synthetic peptide
RRIGVPRRDSFDI

SEQ ID NO: 1214 - protein, 11 aa, Artificial Sequence
  Description of Artificial Sequence: Synthetic peptide
RASQSISSWLA

SEQ ID NO: 1215 - protein, 7 aa, Artificial Sequence
  Description of Artificial Sequence: Synthetic peptide
KASTLES

SEQ ID NO: 1216 - protein, 8 aa, Artificial Sequence
  Description of Artificial Sequence: Synthetic peptide
QQYNTYWT

SEQ ID NO: 1217 - protein, 5 aa, Artificial Sequence
  Description of Artificial Sequence: Synthetic peptide
VYNMH

SEQ ID NO: 1218 - protein, 17 aa, Artificial Sequence
  Description of Artificial Sequence: Synthetic peptide
SIYPSGGMTTYADSVKG

SEQ ID NO: 1219 - protein, 13 aa, Artificial Sequence
  Description of Artificial Sequence: Synthetic peptide
RRTGIPRRDAFDI

SEQ ID NO: 1220 - protein, 11 aa, Artificial Sequence
  Description of Artificial Sequence: Synthetic peptide
RASQSISSWLA

SEQ ID NO: 1221 - protein, 7 aa, Artificial Sequence
  Description of Artificial Sequence: Synthetic peptide
KASTLES

SEQ ID NO: 1222 - protein, 8 aa, Artificial Sequence
  Description of Artificial Sequence: Synthetic peptide
QQYNTYWT

SEQ ID NO: 1223 - protein, 5 aa, Artificial Sequence
  Description of Artificial Sequence: Synthetic peptide
IYDMT

SEQ ID NO: 1224 - protein, 17 aa, Artificial Sequence
  Description of Artificial Sequence: Synthetic peptide
SIYPSGGQTIYADSVKG

SEQ ID NO: 1225 - protein, 13 aa, Artificial Sequence
  Description of Artificial Sequence: Synthetic peptide
RRTGIPRRDAFDI

SEQ ID NO: 1226 - protein, 11 aa, Artificial Sequence
  Description of Artificial Sequence: Synthetic peptide
RASQSISSWLA

SEQ ID NO: 1227 - protein, 7 aa, Artificial Sequence
  Description of Artificial Sequence: Synthetic peptide
KASTLES

SEQ ID NO: 1228 - protein, 8 aa, Artificial Sequence
  Description of Artificial Sequence: Synthetic peptide
QQYNTYWT

SEQ ID NO: 1229 - protein, 5 aa, Artificial Sequence
  Description of Artificial Sequence: Synthetic peptide
HYIMM

SEQ ID NO: 1230 - protein, 17 aa, Artificial Sequence
  Description of Artificial Sequence: Synthetic peptide
GIYSSGGITVYADSVKG

SEQ ID NO: 1231 - protein, 13 aa, Artificial Sequence
  Description of Artificial Sequence: Synthetic peptide
RRTGVPRRDSFDI

SEQ ID NO: 1232 - protein, 11 aa, Artificial Sequence
  Description of Artificial Sequence: Synthetic peptide
RASQSISSWLA

SEQ ID NO: 1233 - protein, 7 aa, Artificial Sequence
  Description of Artificial Sequence: Synthetic peptide
KASTLES

SEQ ID NO: 1234 - protein, 8 aa, Artificial Sequence
  Description of Artificial Sequence: Synthetic peptide
QQYNTYWT

SEQ ID NO: 1235 - protein, 5 aa, Artificial Sequence
  Description of Artificial Sequence: Synthetic peptide
SYNMH

SEQ ID NO: 1236 - protein, 17 aa, Artificial Sequence
  Description of Artificial Sequence: Synthetic peptide
SIVPSGGKTNYADSVKG

SEQ ID NO: 1237 - protein, 13 aa, Artificial Sequence
  Description of Artificial Sequence: Synthetic peptide
RRTGIPRRDAFDI

SEQ ID NO: 1238 - protein, 11 aa, Artificial Sequence
  Description of Artificial Sequence: Synthetic peptide
RASQSISSWLA

SEQ ID NO: 1239 - protein, 7 aa, Artificial Sequence
  Description of Artificial Sequence: Synthetic peptide
KASTLES

SEQ ID NO: 1240 - protein, 8 aa, Artificial Sequence
  Description of Artificial Sequence: Synthetic peptide
QQYNTYWT

SEQ ID NO: 1241 - protein, 5 aa, Artificial Sequence
  Description of Artificial Sequence: Synthetic peptide
RYSMR

SEQ ID NO: 1242 - protein, 17 aa, Artificial Sequence
  Description of Artificial Sequence: Synthetic peptide
VIYPSGGQTYYADSVKG

SEQ ID NO: 1243 - protein, 13 aa, Artificial Sequence
  Description of Artificial Sequence: Synthetic peptide
RRTGIPRRDAFDI

SEQ ID NO: 1244 - protein, 11 aa, Artificial Sequence
  Description of Artificial Sequence: Synthetic peptide
RASQSISSWLA

SEQ ID NO: 1245 - protein, 7 aa, Artificial Sequence
  Description of Artificial Sequence: Synthetic peptide
KASTLES

SEQ ID NO: 1246 - protein, 8 aa, Artificial Sequence
  Description of Artificial Sequence: Synthetic peptide
QQYNTYWT

SEQ ID NO: 1247 - protein, 5 aa, Artificial Sequence
  Description of Artificial Sequence: Synthetic peptide
IYSMQ

SEQ ID NO: 1248 - protein, 17 aa, Artificial Sequence
  Description of Artificial Sequence: Synthetic peptide
SIGSSGGKTLYADSVKG

SEQ ID NO: 1249 - protein, 13 aa, Artificial Sequence
  Description of Artificial Sequence: Synthetic peptide
RRTGIPRRDAFDI

SEQ ID NO: 1250 - protein, 11 aa, Artificial Sequence
  Description of Artificial Sequence: Synthetic peptide
RASQSISSWLA

SEQ ID NO: 1251 - protein, 7 aa, Artificial Sequence
  Description of Artificial Sequence: Synthetic peptide
KASTLES

SEQ ID NO: 1252 - protein, 8 aa, Artificial Sequence
  Description of Artificial Sequence: Synthetic peptide
QQYNTYWT

SEQ ID NO: 1253 - protein, 5 aa, Artificial Sequence
  Description of Artificial Sequence: Synthetic peptide
VYSMT

SEQ ID NO: 1254 - protein, 17 aa, Artificial Sequence
  Description of Artificial Sequence: Synthetic peptide
SIGSSGGSTTYADSVKG

SEQ ID NO: 1255 - protein, 13 aa, Artificial Sequence
  Description of Artificial Sequence: Synthetic peptide
RRTGIPRRDAFDI

SEQ ID NO: 1256 - protein, 11 aa, Artificial Sequence
  Description of Artificial Sequence: Synthetic peptide
RASQSISSWLA

SEQ ID NO: 1257 - protein, 7 aa, Artificial Sequence
  Description of Artificial Sequence: Synthetic peptide
KASTLES

SEQ ID NO: 1258 - protein, 8 aa, Artificial Sequence
  Description of Artificial Sequence: Synthetic peptide
QQYNTYWT

SEQ ID NO: 1259 - protein, 5 aa, Artificial Sequence
  Description of Artificial Sequence: Synthetic peptide
IYDMN

SEQ ID NO: 1260 - protein, 17 aa, Artificial Sequence
  Description of Artificial Sequence: Synthetic peptide
SIYPSGGRTRYADSVKG

SEQ ID NO: 1261 - protein, 13 aa, Artificial Sequence
  Description of Artificial Sequence: Synthetic peptide
RRTGIPRRDAFDI

SEQ ID NO: 1262 - protein, 11 aa, Artificial Sequence
  Description of Artificial Sequence: Synthetic peptide
RASQSISSWLA

SEQ ID NO: 1263 - protein, 7 aa, Artificial Sequence
  Description of Artificial Sequence: Synthetic peptide
KASTLES

SEQ ID NO: 1264 - protein, 8 aa, Artificial Sequence
  Description of Artificial Sequence: Synthetic peptide
QQYNTYWT

SEQ ID NO: 1265 - protein, 5 aa, Artificial Sequence
  Description of Artificial Sequence: Synthetic peptide
HYIMM

SEQ ID NO: 1266 - protein, 17 aa, Artificial Sequence
  Description of Artificial Sequence: Synthetic peptide
GIYSSGGITVYADSVKG

SEQ ID NO: 1267 - protein, 13 aa, Artificial Sequence
  Description of Artificial Sequence: Synthetic peptide
RRTGVPRRDDFDI

SEQ ID NO: 1268 - protein, 11 aa, Artificial Sequence
  Description of Artificial Sequence: Synthetic peptide
RASQSISSWLA

SEQ ID NO: 1269 - protein, 7 aa, Artificial Sequence
  Description of Artificial Sequence: Synthetic peptide
KASTLES

SEQ ID NO: 1270 - protein, 8 aa, Artificial Sequence
  Description of Artificial Sequence: Synthetic peptide
QQYNTYWT

SEQ ID NO: 1271 - protein, 6 aa, Artificial Sequence
  Description of Artificial Sequence: Synthetic peptide
HYMGMN

SEQ ID NO: 1272 - protein, 17 aa, Artificial Sequence
  Description of Artificial Sequence: Synthetic peptide
SIVPSGGWTQYADSVKG

SEQ ID NO: 1273 - protein, 13 aa, Artificial Sequence
  Description of Artificial Sequence: Synthetic peptide
RRTGIPRRDAFDI

SEQ ID NO: 1274 - protein, 11 aa, Artificial Sequence
  Description of Artificial Sequence: Synthetic peptide
RASQSISSWLA

SEQ ID NO: 1275 - protein, 7 aa, Artificial Sequence
  Description of Artificial Sequence: Synthetic peptide
KASTLES

SEQ ID NO: 1276 - protein, 8 aa, Artificial Sequence
  Description of Artificial Sequence: Synthetic peptide
QQYNTYWT

SEQ ID NO: 1277 - protein, 5 aa, Artificial Sequence
  Description of Artificial Sequence: Synthetic peptide
TYTMR

SEQ ID NO: 1278 - protein, 17 aa, Artificial Sequence
  Description of Artificial Sequence: Synthetic peptide
SIYPSGGKTQYADSVKG

SEQ ID NO: 1279 - protein, 13 aa, Artificial Sequence
  Description of Artificial Sequence: Synthetic peptide
RRTGIPRRDAFDI

SEQ ID NO: 1280 - protein, 11 aa, Artificial Sequence
  Description of Artificial Sequence: Synthetic peptide
RASQSISSWLA

SEQ ID NO: 1281 - protein, 7 aa, Artificial Sequence
  Description of Artificial Sequence: Synthetic peptide
KASTLES

SEQ ID NO: 1282 - protein, 8 aa, Artificial Sequence
  Description of Artificial Sequence: Synthetic peptide
QQYNTYWT

SEQ ID NO: 1283 - protein, 5 aa, Artificial Sequence
  Description of Artificial Sequence: Synthetic peptide
IYDMW

SEQ ID NO: 1284 - protein, 17 aa, Artificial Sequence
  Description of Artificial Sequence: Synthetic peptide
SIRPSGGITKYADSVKG

SEQ ID NO: 1285 - protein, 13 aa, Artificial Sequence
  Description of Artificial Sequence: Synthetic peptide
RRTGIPRRDAFDI

SEQ ID NO: 1286 - protein, 11 aa, Artificial Sequence
  Description of Artificial Sequence: Synthetic peptide
RASQSISSWLA

SEQ ID NO: 1287 - protein, 7 aa, Artificial Sequence
  Description of Artificial Sequence: Synthetic peptide
KASTLES

SEQ ID NO: 1288 - protein, 8 aa, Artificial Sequence
  Description of Artificial Sequence: Synthetic peptide
QQYNTYWT

SEQ ID NO: 1289 - protein, 5 aa, Artificial Sequence
  Description of Artificial Sequence: Synthetic peptide
IYNMI

SEQ ID NO: 1290 - protein, 17 aa, Artificial Sequence
  Description of Artificial Sequence: Synthetic peptide
SIYPSGGWTTYADSVKG

SEQ ID NO: 1291 - protein, 13 aa, Artificial Sequence
  Description of Artificial Sequence: Synthetic peptide
RRTGIPRRDAFDI

SEQ ID NO: 1292 - protein, 11 aa, Artificial Sequence
  Description of Artificial Sequence: Synthetic peptide
RASQSISSWLA

SEQ ID NO: 1293 - protein, 7 aa, Artificial Sequence
  Description of Artificial Sequence: Synthetic peptide
KASTLES

SEQ ID NO: 1294 - protein, 8 aa, Artificial Sequence
  Description of Artificial Sequence: Synthetic peptide
QQYNTYWT

SEQ ID NO: 1295 - protein, 5 aa, Artificial Sequence
  Description of Artificial Sequence: Synthetic peptide
IYHMY

SEQ ID NO: 1296 - protein, 17 aa, Artificial Sequence
  Description of Artificial Sequence: Synthetic peptide
SIGPSGGPTGYADSVKG

SEQ ID NO: 1297 - protein, 13 aa, Artificial Sequence
  Description of Artificial Sequence: Synthetic peptide
RRTGIPRRDAFDI

SEQ ID NO: 1298 - protein, 11 aa, Artificial Sequence
  Description of Artificial Sequence: Synthetic peptide
RASQSISSWLA

SEQ ID NO: 1299 - protein, 7 aa, Artificial Sequence
  Description of Artificial Sequence: Synthetic peptide
KASTLES

SEQ ID NO: 1300 - protein, 8 aa, Artificial Sequence
  Description of Artificial Sequence: Synthetic peptide
QQYNTYWT

SEQ ID NO: 1301 - protein, 5 aa, Artificial Sequence
  Description of Artificial Sequence: Synthetic peptide
TYSMY

SEQ ID NO: 1302 - protein, 17 aa, Artificial Sequence
  Description of Artificial Sequence: Synthetic peptide
SIYPSGGLTWYADSVKG

SEQ ID NO: 1303 - protein, 13 aa, Artificial Sequence
  Description of Artificial Sequence: Synthetic peptide
RRTGIPRRDAFDI

SEQ ID NO: 1304 - protein, 11 aa, Artificial Sequence
  Description of Artificial Sequence: Synthetic peptide
RASQSISSWLA

SEQ ID NO: 1305 - protein, 7 aa, Artificial Sequence
  Description of Artificial Sequence: Synthetic peptide
KASTLES

SEQ ID NO: 1306 - protein, 8 aa, Artificial Sequence
  Description of Artificial Sequence: Synthetic peptide
QQYNTYWT

SEQ ID NO: 1307 - protein, 5 aa, Artificial Sequence
  Description of Artificial Sequence: Synthetic peptide
HYIMM

SEQ ID NO: 1308 - protein, 17 aa, Artificial Sequence
  Description of Artificial Sequence: Synthetic peptide
GIYSSGGITVYADSVKG

SEQ ID NO: 1309 - protein, 13 aa, Artificial Sequence
  Description of Artificial Sequence: Synthetic peptide
RRIGVPRRDDFDI

SEQ ID NO: 1310 - protein, 11 aa, Artificial Sequence
  Description of Artificial Sequence: Synthetic peptide
RASQSISSWLA

SEQ ID NO: 1311 - protein, 7 aa, Artificial Sequence
  Description of Artificial Sequence: Synthetic peptide
KASTLES

SEQ ID NO: 1312 - protein, 8 aa, Artificial Sequence
  Description of Artificial Sequence: Synthetic peptide
QQYNTYWT

SEQ ID NO: 1313 - protein, 5 aa, Artificial Sequence
  Description of Artificial Sequence: Synthetic peptide
IYDMY

SEQ ID NO: 1314 - protein, 17 aa, Artificial Sequence
  Description of Artificial Sequence: Synthetic peptide
SIGPSGGPTAYADSVKG

SEQ ID NO: 1315 - protein, 13 aa, Artificial Sequence
  Description of Artificial Sequence: Synthetic peptide
RRTGIPRRDAFDI

SEQ ID NO: 1316 - protein, 11 aa, Artificial Sequence
  Description of Artificial Sequence: Synthetic peptide
RASQSISSWLA

SEQ ID NO: 1317 - protein, 7 aa, Artificial Sequence
  Description of Artificial Sequence: Synthetic peptide
KASTLES

SEQ ID NO: 1318 - protein, 8 aa, Artificial Sequence
  Description of Artificial Sequence: Synthetic peptide
QQYNTYWT

SEQ ID NO: 1319 - protein, 5 aa, Artificial Sequence
  Description of Artificial Sequence: Synthetic peptide
VYSMW

SEQ ID NO: 1320 - protein, 17 aa, Artificial Sequence
  Description of Artificial Sequence: Synthetic peptide
SISSSGGMTEYADSVKG

SEQ ID NO: 1321 - protein, 13 aa, Artificial Sequence
  Description of Artificial Sequence: Synthetic peptide
RRTGIPRRDAFDI

SEQ ID NO: 1322 - protein, 11 aa, Artificial Sequence
  Description of Artificial Sequence: Synthetic peptide
RASQSISSWLA

SEQ ID NO: 1323 - protein, 7 aa, Artificial Sequence
  Description of Artificial Sequence: Synthetic peptide
KASTLES

SEQ ID NO: 1324 - protein, 8 aa, Artificial Sequence
  Description of Artificial Sequence: Synthetic peptide
QQYNTYWT

SEQ ID NO: 1325 - protein, 5 aa, Artificial Sequence
  Description of Artificial Sequence: Synthetic peptide
HYIMM

SEQ ID NO: 1326 - protein, 17 aa, Artificial Sequence
  Description of Artificial Sequence: Synthetic peptide
GIYSSGGITVYADSVKG

SEQ ID NO: 1327 - protein, 13 aa, Artificial Sequence
  Description of Artificial Sequence: Synthetic peptide
RRRGVPRRDDFDI

SEQ ID NO: 1328 - protein, 11 aa, Artificial Sequence
  Description of Artificial Sequence: Synthetic peptide
RASQSISSWLA

SEQ ID NO: 1329 - protein, 7 aa, Artificial Sequence
  Description of Artificial Sequence: Synthetic peptide
KASTLES

SEQ ID NO: 1330 - protein, 8 aa, Artificial Sequence
  Description of Artificial Sequence: Synthetic peptide
QQYNTYWT

SEQ ID NO: 1331 - protein, 5 aa, Artificial Sequence
  Description of Artificial Sequence: Synthetic peptide
IYGMF

SEQ ID NO: 1332 - protein, 17 aa, Artificial Sequence
  Description of Artificial Sequence: Synthetic peptide
GIGPSGGPTKYADSVKG

SEQ ID NO: 1333 - protein, 13 aa, Artificial Sequence
  Description of Artificial Sequence: Synthetic peptide
RRTGIPRRDAFDI

SEQ ID NO: 1334 - protein, 11 aa, Artificial Sequence
  Description of Artificial Sequence: Synthetic peptide
RASQSISSWLA

SEQ ID NO: 1335 - protein, 7 aa, Artificial Sequence
  Description of Artificial Sequence: Synthetic peptide
KASTLES

SEQ ID NO: 1336 - protein, 8 aa, Artificial Sequence
  Description of Artificial Sequence: Synthetic peptide
QQYNTYWT

SEQ ID NO: 1337 - protein, 5 aa, Artificial Sequence
  Description of Artificial Sequence: Synthetic peptide
IYSMF

SEQ ID NO: 1338 - protein, 17 aa, Artificial Sequence
  Description of Artificial Sequence: Synthetic peptide
SIGPSGGVTHYADSVKG

SEQ ID NO: 1339 - protein, 13 aa, Artificial Sequence
  Description of Artificial Sequence: Synthetic peptide
RRTGIPRRDAFDI

SEQ ID NO: 1340 - protein, 11 aa, Artificial Sequence
  Description of Artificial Sequence: Synthetic peptide
RASQSISSWLA

SEQ ID NO: 1341 - protein, 7 aa, Artificial Sequence
  Description of Artificial Sequence: Synthetic peptide
KASTLES

SEQ ID NO: 1342 - protein, 8 aa, Artificial Sequence
  Description of Artificial Sequence: Synthetic peptide
QQYNTYWT

SEQ ID NO: 1343 - protein, 5 aa, Artificial Sequence
  Description of Artificial Sequence: Synthetic peptide
IYSMY

SEQ ID NO: 1344 - protein, 17 aa, Artificial Sequence
  Description of Artificial Sequence: Synthetic peptide
YIRPSGGNTKYADSVKG

SEQ ID NO: 1345 - protein, 13 aa, Artificial Sequence
  Description of Artificial Sequence: Synthetic peptide
RRTGIPRRDAFDI

SEQ ID NO: 1346 - protein, 11 aa, Artificial Sequence
  Description of Artificial Sequence: Synthetic peptide
RASQSISSWLA

SEQ ID NO: 1347 - protein, 7 aa, Artificial Sequence
  Description of Artificial Sequence: Synthetic peptide
KASTLES

SEQ ID NO: 1348 - protein, 8 aa, Artificial Sequence
  Description of Artificial Sequence: Synthetic peptide
QQYNTYWT

SEQ ID NO: 1349 - protein, 5 aa, Artificial Sequence
  Description of Artificial Sequence: Synthetic peptide
RYSMI

SEQ ID NO: 1350 - protein, 17 aa, Artificial Sequence
  Description of Artificial Sequence: Synthetic peptide
SIWSSGGATEYADSVKG

SEQ ID NO: 1351 - protein, 13 aa, Artificial Sequence
  Description of Artificial Sequence: Synthetic peptide
RRTGIPRRDAFDI

SEQ ID NO: 1352 - protein, 11 aa, Artificial Sequence
  Description of Artificial Sequence: Synthetic peptide
RASQSISSWLA

SEQ ID NO: 1353 - protein, 7 aa, Artificial Sequence
  Description of Artificial Sequence: Synthetic peptide
KASTLES

SEQ ID NO: 1354 - protein, 8 aa, Artificial Sequence
  Description of Artificial Sequence: Synthetic peptide
QQYNTYWT

SEQ ID NO: 1355 - protein, 5 aa, Artificial Sequence
  Description of Artificial Sequence: Synthetic peptide
HYIMM

SEQ ID NO: 1356 - protein, 17 aa, Artificial Sequence
  Description of Artificial Sequence: Synthetic peptide
GIYSSGGITVYADSVKG

SEQ ID NO: 1357 - protein, 13 aa, Artificial Sequence
  Description of Artificial Sequence: Synthetic peptide
RRIGVPRRDAFDI

SEQ ID NO: 1358 - protein, 11 aa, Artificial Sequence
  Description of Artificial Sequence: Synthetic peptide
RASQSISSWLA

SEQ ID NO: 1359 - protein, 7 aa, Artificial Sequence
  Description of Artificial Sequence: Synthetic peptide
KASTLES

SEQ ID NO: 1360 - protein, 8 aa, Artificial Sequence
  Description of Artificial Sequence: Synthetic peptide
QQYNTYWT

SEQ ID NO: 1361 - protein, 5 aa, Artificial Sequence
  Description of Artificial Sequence: Synthetic peptide
HYIMM

SEQ ID NO: 1362 - protein, 17 aa, Artificial Sequence
  Description of Artificial Sequence: Synthetic peptide
GIYSSGGITVYADSVKG

SEQ ID NO: 1363 - protein, 13 aa, Artificial Sequence
  Description of Artificial Sequence: Synthetic peptide
RRTGVPRRDSFEI

SEQ ID NO: 1364 - protein, 11 aa, Artificial Sequence
  Description of Artificial Sequence: Synthetic peptide
RASQSISSWLA

SEQ ID NO: 1365 - protein, 7 aa, Artificial Sequence
  Description of Artificial Sequence: Synthetic peptide
KASTLES

SEQ ID NO: 1366 - protein, 8 aa, Artificial Sequence
  Description of Artificial Sequence: Synthetic peptide
QQYNTYWT

SEQ ID NO: 1367 - protein, 5 aa, Artificial Sequence
  Description of Artificial Sequence: Synthetic peptide
KYWMY

SEQ ID NO: 1368 - protein, 17 aa, Artificial Sequence
  Description of Artificial Sequence: Synthetic peptide
YIRPSGGQTYYADSVKG

SEQ ID NO: 1369 - protein, 13 aa, Artificial Sequence
  Description of Artificial Sequence: Synthetic peptide
RRTGIPRRDAFDI

SEQ ID NO: 1370 - protein, 11 aa, Artificial Sequence
  Description of Artificial Sequence: Synthetic peptide
RASQSISSWLA

SEQ ID NO: 1371 - protein, 7 aa, Artificial Sequence
  Description of Artificial Sequence: Synthetic peptide
KASTLES

SEQ ID NO: 1372 - protein, 8 aa, Artificial Sequence
  Description of Artificial Sequence: Synthetic peptide
QQYNTYWT

SEQ ID NO: 1373 - protein, 5 aa, Artificial Sequence
  Description of Artificial Sequence: Synthetic peptide
RYQMH

SEQ ID NO: 1374 - protein, 17 aa, Artificial Sequence
  Description of Artificial Sequence: Synthetic peptide
WISPSGGITGYADSVKG

SEQ ID NO: 1375 - protein, 13 aa, Artificial Sequence
  Description of Artificial Sequence: Synthetic peptide
RRTGIPRRDAFDI

SEQ ID NO: 1376 - protein, 11 aa, Artificial Sequence
  Description of Artificial Sequence: Synthetic peptide
RASQSISSWLA

SEQ ID NO: 1377 - protein, 7 aa, Artificial Sequence
  Description of Artificial Sequence: Synthetic peptide
KASTLES

SEQ ID NO: 1378 - protein, 8 aa, Artificial Sequence
  Description of Artificial Sequence: Synthetic peptide
QQYNTYWT

SEQ ID NO: 1379 - protein, 5 aa, Artificial Sequence
  Description of Artificial Sequence: Synthetic peptide
PYNMY

SEQ ID NO: 1380 - protein, 16 aa, Artificial Sequence
  Description of Artificial Sequence: Synthetic peptide
WIVPGGVTKYADSVKG

SEQ ID NO: 1381 - protein, 13 aa, Artificial Sequence
  Description of Artificial Sequence: Synthetic peptide
RRTGIPRRDAFDI

SEQ ID NO: 1382 - protein, 11 aa, Artificial Sequence
  Description of Artificial Sequence: Synthetic peptide
RASQSISSWLA

SEQ ID NO: 1383 - protein, 7 aa, Artificial Sequence
  Description of Artificial Sequence: Synthetic peptide
KASTLES

SEQ ID NO: 1384 - protein, 8 aa, Artificial Sequence
  Description of Artificial Sequence: Synthetic peptide
QQYNTYWT

SEQ ID NO: 1385 - protein, 5 aa, Artificial Sequence
  Description of Artificial Sequence: Synthetic peptide
HYIMM

SEQ ID NO: 1386 - protein, 17 aa, Artificial Sequence
  Description of Artificial Sequence: Synthetic peptide
GIYSSGGITVYADSVKG

SEQ ID NO: 1387 - protein, 13 aa, Artificial Sequence
  Description of Artificial Sequence: Synthetic peptide
RRTGVPRRNAFDN

SEQ ID NO: 1388 - protein, 11 aa, Artificial Sequence
  Description of Artificial Sequence: Synthetic peptide
RASQSISSWLA

SEQ ID NO: 1389 - protein, 7 aa, Artificial Sequence
  Description of Artificial Sequence: Synthetic peptide
KASTLES

SEQ ID NO: 1390 - protein, 8 aa, Artificial Sequence
  Description of Artificial Sequence: Synthetic peptide
QQYNTYWT

SEQ ID NO: 1391 - protein, 5 aa, Artificial Sequence
  Description of Artificial Sequence: Synthetic peptide
HYIMM

SEQ ID NO: 1392 - protein, 17 aa, Artificial Sequence
  Description of Artificial Sequence: Synthetic peptide
GIYSSGGITVYADSVKG

SEQ ID NO: 1393 - protein, 13 aa, Artificial Sequence
  Description of Artificial Sequence: Synthetic peptide
RRTGVPRRDAFDI

SEQ ID NO: 1394 - protein, 11 aa, Artificial Sequence
  Description of Artificial Sequence: Synthetic peptide
RASQSISSWLA

SEQ ID NO: 1395 - protein, 7 aa, Artificial Sequence
  Description of Artificial Sequence: Synthetic peptide
KASTLES

SEQ ID NO: 1396 - protein, 8 aa, Artificial Sequence
  Description of Artificial Sequence: Synthetic peptide
QQYNTYWT

SEQ ID NO: 1397 - protein, 5 aa, Artificial Sequence
  Description of Artificial Sequence: Synthetic peptide
HYIMM

SEQ ID NO: 1398 - protein, 17 aa, Artificial Sequence
  Description of Artificial Sequence: Synthetic peptide
GIYSSGGITVYADSVKG

SEQ ID NO: 1399 - protein, 13 aa, Artificial Sequence
  Description of Artificial Sequence: Synthetic peptide
RRTGVPRWDAFDI

SEQ ID NO: 1400 - protein, 11 aa, Artificial Sequence
  Description of Artificial Sequence: Synthetic peptide
RASQSISSWLA

SEQ ID NO: 1401 - protein, 7 aa, Artificial Sequence
  Description of Artificial Sequence: Synthetic peptide
KASTLES

SEQ ID NO: 1402 - protein, 8 aa, Artificial Sequence
  Description of Artificial Sequence: Synthetic peptide
QQYNTYWT

SEQ ID NO: 1403 - protein, 5 aa, Artificial Sequence
  Description of Artificial Sequence: Synthetic peptide
MYQMF

SEQ ID NO: 1404 - protein, 16 aa, Artificial Sequence
  Description of Artificial Sequence: Synthetic peptide
SISPGGGTQYADSVKG

SEQ ID NO: 1405 - protein, 13 aa, Artificial Sequence
  Description of Artificial Sequence: Synthetic peptide
RRTGIPRRDAFDI

SEQ ID NO: 1406 - protein, 11 aa, Artificial Sequence
  Description of Artificial Sequence: Synthetic peptide
RASQSISSWLA

SEQ ID NO: 1407 - protein, 7 aa, Artificial Sequence
  Description of Artificial Sequence: Synthetic peptide
KASTLES

SEQ ID NO: 1408 - protein, 8 aa, Artificial Sequence
  Description of Artificial Sequence: Synthetic peptide
QQYNTYWT

SEQ ID NO: 1409 - protein, 5 aa, Artificial Sequence
  Description of Artificial Sequence: Synthetic peptide
HYIMM

SEQ ID NO: 1410 - protein, 17 aa, Artificial Sequence
  Description of Artificial Sequence: Synthetic peptide
GIYSSGGITVYADSVKG

SEQ ID NO: 1411 - protein, 13 aa, Artificial Sequence
  Description of Artificial Sequence: Synthetic peptide
RRTGVPRRDVFDI

SEQ ID NO: 1412 - protein, 11 aa, Artificial Sequence
  Description of Artificial Sequence: Synthetic peptide
RASQSISSWLA

SEQ ID NO: 1413 - protein, 7 aa, Artificial Sequence
  Description of Artificial Sequence: Synthetic peptide
KASTLES

SEQ ID NO: 1414 - protein, 8 aa, Artificial Sequence
  Description of Artificial Sequence: Synthetic peptide
QQYNTYWT

SEQ ID NO: 1415 - protein, 5 aa, Artificial Sequence
  Description of Artificial Sequence: Synthetic peptide
RYKMY

SEQ ID NO: 1416 - protein, 17 aa, Artificial Sequence
  Description of Artificial Sequence: Synthetic peptide
VIGPSGGATFYADSVKG

SEQ ID NO: 1417 - protein, 13 aa, Artificial Sequence
  Description of Artificial Sequence: Synthetic peptide
RRTGIPRRDAFDI

SEQ ID NO: 1418 - protein, 11 aa, Artificial Sequence
  Description of Artificial Sequence: Synthetic peptide
RASQSISSWLA

SEQ ID NO: 1419 - protein, 7 aa, Artificial Sequence
  Description of Artificial Sequence: Synthetic peptide
KASTLES

SEQ ID NO: 1420 - protein, 8 aa, Artificial Sequence
  Description of Artificial Sequence: Synthetic peptide
QQYNTYWT

SEQ ID NO: 1421 - protein, 5 aa, Artificial Sequence
  Description of Artificial Sequence: Synthetic peptide
RYVMW

SEQ ID NO: 1422 - protein, 16 aa, Artificial Sequence
  Description of Artificial Sequence: Synthetic peptide
SISPSGDTHYADSVKG

SEQ ID NO: 1423 - protein, 13 aa, Artificial Sequence
  Description of Artificial Sequence: Synthetic peptide
RRTGIPRRDAFDI

SEQ ID NO: 1424 - protein, 11 aa, Artificial Sequence
  Description of Artificial Sequence: Synthetic peptide
RASQSISSWLA

SEQ ID NO: 1425 - protein, 7 aa, Artificial Sequence
  Description of Artificial Sequence: Synthetic peptide
KASTLES

SEQ ID NO: 1426 - protein, 8 aa, Artificial Sequence
  Description of Artificial Sequence: Synthetic peptide
QQYNTYWT

SEQ ID NO: 1427 - protein, 5 aa, Artificial Sequence
  Description of Artificial Sequence: Synthetic peptide
HYIMM

SEQ ID NO: 1428 - protein, 17 aa, Artificial Sequence
  Description of Artificial Sequence: Synthetic peptide
GIYSSGGITVYADSVKG

SEQ ID NO: 1429 - protein, 13 aa, Artificial Sequence
  Description of Artificial Sequence: Synthetic peptide
RRTGVPRRDAFDN

SEQ ID NO: 1430 - protein, 11 aa, Artificial Sequence
  Description of Artificial Sequence: Synthetic peptide
RASQSISSWLA

SEQ ID NO: 1431 - protein, 7 aa, Artificial Sequence
  Description of Artificial Sequence: Synthetic peptide
KASTLES

SEQ ID NO: 1432 - protein, 8 aa, Artificial Sequence
  Description of Artificial Sequence: Synthetic peptide
QQYNTYWT

SEQ ID NO: 1433 - protein, 5 aa, Artificial Sequence
  Description of Artificial Sequence: Synthetic peptide
HYIMM

SEQ ID NO: 1434 - protein, 17 aa, Artificial Sequence
  Description of Artificial Sequence: Synthetic peptide
GIYSSGGITVYADSVKG

SEQ ID NO: 1435 - protein, 13 aa, Artificial Sequence
  Description of Artificial Sequence: Synthetic peptide
RRSGVPRRDDFDI

SEQ ID NO: 1436 - protein, 11 aa, Artificial Sequence
  Description of Artificial Sequence: Synthetic peptide
RASQSISSWLA

SEQ ID NO: 1437 - protein, 7 aa, Artificial Sequence
  Description of Artificial Sequence: Synthetic peptide
KASTLES

SEQ ID NO: 1438 - protein, 8 aa, Artificial Sequence
  Description of Artificial Sequence: Synthetic peptide
QQYNTYWT

SEQ ID NO: 1439 - protein, 5 aa, Artificial Sequence
  Description of Artificial Sequence: Synthetic peptide
HYIMM

SEQ ID NO: 1440 - protein, 17 aa, Artificial Sequence
  Description of Artificial Sequence: Synthetic peptide
GIYSSGGITVYADSVKG

SEQ ID NO: 1441 - protein, 13 aa, Artificial Sequence
  Description of Artificial Sequence: Synthetic peptide
RRKGIPRRDDFDI

SEQ ID NO: 1442 - protein, 11 aa, Artificial Sequence
  Description of Artificial Sequence: Synthetic peptide
RASQSISSWLA

SEQ ID NO: 1443 - protein, 7 aa, Artificial Sequence
  Description of Artificial Sequence: Synthetic peptide
KASTLES

SEQ ID NO: 1444 - protein, 8 aa, Artificial Sequence
  Description of Artificial Sequence: Synthetic peptide
QQYNTYWT

SEQ ID NO: 1445 - protein, 5 aa, Artificial Sequence
  Description of Artificial Sequence: Synthetic peptide
KYSMA

SEQ ID NO: 1446 - protein, 17 aa, Artificial Sequence
  Description of Artificial Sequence: Synthetic peptide
GIYPSGGRTLYADSVKG

SEQ ID NO: 1447 - protein, 13 aa, Artificial Sequence
  Description of Artificial Sequence: Synthetic peptide
RRTGIPRRDAFDI

SEQ ID NO: 1448 - protein, 11 aa, Artificial Sequence
  Description of Artificial Sequence: Synthetic peptide
RASQSISSWLA

SEQ ID NO: 1449 - protein, 7 aa, Artificial Sequence
  Description of Artificial Sequence: Synthetic peptide
KASTLES

SEQ ID NO: 1450 - protein, 8 aa, Artificial Sequence
  Description of Artificial Sequence: Synthetic peptide
QQYNTYWT

SEQ ID NO: 1451 - protein, 5 aa, Artificial Sequence
  Description of Artificial Sequence: Synthetic peptide
IYFMS

SEQ ID NO: 1452 - protein, 17 aa, Artificial Sequence
  Description of Artificial Sequence: Synthetic peptide
SIRSSGGPTWYADSVKG

SEQ ID NO: 1453 - protein, 13 aa, Artificial Sequence
  Description of Artificial Sequence: Synthetic peptide
RRTGIPRRDAFDI

SEQ ID NO: 1454 - protein, 11 aa, Artificial Sequence
  Description of Artificial Sequence: Synthetic peptide
RASQSISSWLA

SEQ ID NO: 1455 - protein, 7 aa, Artificial Sequence
  Description of Artificial Sequence: Synthetic peptide
KASTLES

SEQ ID NO: 1456 - protein, 8 aa, Artificial Sequence
  Description of Artificial Sequence: Synthetic peptide
QQYNTYWT

SEQ ID NO: 1457 - protein, 5 aa, Artificial Sequence
  Description of Artificial Sequence: Synthetic peptide
QYFMH

SEQ ID NO: 1458 - protein, 17 aa, Artificial Sequence
  Description of Artificial Sequence: Synthetic peptide
YIYPSGGMTEYADSVKG

SEQ ID NO: 1459 - protein, 13 aa, Artificial Sequence
  Description of Artificial Sequence: Synthetic peptide
RRTGIPRRDAFDI

SEQ ID NO: 1460 - protein, 11 aa, Artificial Sequence
  Description of Artificial Sequence: Synthetic peptide
RASQSISSWLA

SEQ ID NO: 1461 - protein, 7 aa, Artificial Sequence
  Description of Artificial Sequence: Synthetic peptide
KASTLES

SEQ ID NO: 1462 - protein, 8 aa, Artificial Sequence
  Description of Artificial Sequence: Synthetic peptide
QQYNTYWT

SEQ ID NO: 1463 - protein, 5 aa, Artificial Sequence
  Description of Artificial Sequence: Synthetic peptide
IYTMY

SEQ ID NO: 1464 - protein, 17 aa, Artificial Sequence
  Description of Artificial Sequence: Synthetic peptide
SISPSGGWTYYADSVKG

SEQ ID NO: 1465 - protein, 13 aa, Artificial Sequence
  Description of Artificial Sequence: Synthetic peptide
RRTGIPRRDAFDI

SEQ ID NO: 1466 - protein, 11 aa, Artificial Sequence
  Description of Artificial Sequence: Synthetic peptide
RASQSISSWLA

SEQ ID NO: 1467 - protein, 7 aa, Artificial Sequence
  Description of Artificial Sequence: Synthetic peptide
KASTLES

SEQ ID NO: 1468 - protein, 8 aa, Artificial Sequence
  Description of Artificial Sequence: Synthetic peptide
QQYNTYWT

SEQ ID NO: 1469 - protein, 5 aa, Artificial Sequence
  Description of Artificial Sequence: Synthetic peptide
PYLMW

SEQ ID NO: 1470 - protein, 17 aa, Artificial Sequence
  Description of Artificial Sequence: Synthetic peptide
YIGPSGGPTHYADSVKG

SEQ ID NO: 1471 - protein, 13 aa, Artificial Sequence
  Description of Artificial Sequence: Synthetic peptide
RRTGIPRRDAFDI

SEQ ID NO: 1472 - protein, 11 aa, Artificial Sequence
  Description of Artificial Sequence: Synthetic peptide
RASQSISSWLA

SEQ ID NO: 1473 - protein, 7 aa, Artificial Sequence
  Description of Artificial Sequence: Synthetic peptide
KASTLES

SEQ ID NO: 1474 - protein, 8 aa, Artificial Sequence
  Description of Artificial Sequence: Synthetic peptide
QQYNTYWT

SEQ ID NO: 1475 - protein, 5 aa, Artificial Sequence
  Description of Artificial Sequence: Synthetic peptide
IYTMM

SEQ ID NO: 1476 - protein, 17 aa, Artificial Sequence
  Description of Artificial Sequence: Synthetic peptide
SIWSSGGQTKYADSVKG

SEQ ID NO: 1477 - protein, 13 aa, Artificial Sequence
  Description of Artificial Sequence: Synthetic peptide
RRTGIPRRDAFDI

SEQ ID NO: 1478 - protein, 11 aa, Artificial Sequence
  Description of Artificial Sequence: Synthetic peptide
RASQSISSWLA

SEQ ID NO: 1479 - protein, 7 aa, Artificial Sequence
  Description of Artificial Sequence: Synthetic peptide
KASTLES

SEQ ID NO: 1480 - protein, 8 aa, Artificial Sequence
  Description of Artificial Sequence: Synthetic peptide
QQYNTYWT

SEQ ID NO: 1481 - protein, 5 aa, Artificial Sequence
  Description of Artificial Sequence: Synthetic peptide
HYIMM

SEQ ID NO: 1482 - protein, 17 aa, Artificial Sequence
  Description of Artificial Sequence: Synthetic peptide
GIYSSGGITVYADSVKG

SEQ ID NO: 1483 - protein, 13 aa, Artificial Sequence
  Description of Artificial Sequence: Synthetic peptide
RRTGVPRRDALDN

SEQ ID NO: 1484 - protein, 11 aa, Artificial Sequence
  Description of Artificial Sequence: Synthetic peptide
RASQSISSWLA

SEQ ID NO: 1485 - protein, 7 aa, Artificial Sequence
  Description of Artificial Sequence: Synthetic peptide
KASTLES

SEQ ID NO: 1486 - protein, 8 aa, Artificial Sequence
  Description of Artificial Sequence: Synthetic peptide
QQYNTYWT

SEQ ID NO: 1487 - protein, 5 aa, Artificial Sequence
  Description of Artificial Sequence: Synthetic peptide
HYIMM

SEQ ID NO: 1488 - protein, 17 aa, Artificial Sequence
  Description of Artificial Sequence: Synthetic peptide
GIYSSGGITVYADSVKG

SEQ ID NO: 1489 - protein, 13 aa, Artificial Sequence
  Description of Artificial Sequence: Synthetic peptide
RRPGVPRRDAFDI

SEQ ID NO: 1490 - protein, 11 aa, Artificial Sequence
  Description of Artificial Sequence: Synthetic peptide
RASQSISSWLA

SEQ ID NO: 1491 - protein, 7 aa, Artificial Sequence
  Description of Artificial Sequence: Synthetic peptide
KASTLES

SEQ ID NO: 1492 - protein, 8 aa, Artificial Sequence
  Description of Artificial Sequence: Synthetic peptide
QQYNTYWT

SEQ ID NO: 1493 - protein, 5 aa, Artificial Sequence
  Description of Artificial Sequence: Synthetic peptide
RYSMS

SEQ ID NO: 1494 - protein, 17 aa, Artificial Sequence
  Description of Artificial Sequence: Synthetic peptide
GISPSGGETSYADSVKG

SEQ ID NO: 1495 - protein, 13 aa, Artificial Sequence
  Description of Artificial Sequence: Synthetic peptide
RRTGIPRRDAFDI

SEQ ID NO: 1496 - protein, 11 aa, Artificial Sequence
  Description of Artificial Sequence: Synthetic peptide
RASQSISSWLA

SEQ ID NO: 1497 - protein, 7 aa, Artificial Sequence
  Description of Artificial Sequence: Synthetic peptide
KASTLES

SEQ ID NO: 1498 - protein, 8 aa, Artificial Sequence
  Description of Artificial Sequence: Synthetic peptide
QQYNTYWT

SEQ ID NO: 1499 - protein, 5 aa, Artificial Sequence
  Description of Artificial Sequence: Synthetic peptide
WYMMQ

SEQ ID NO: 1500 - protein, 16 aa, Artificial Sequence
  Description of Artificial Sequence: Synthetic peptide
RISPSGGTTYADSVKG

SEQ ID NO: 1501 - protein, 13 aa, Artificial Sequence
  Description of Artificial Sequence: Synthetic peptide
RRTGIPRRDAFDI

SEQ ID NO: 1502 - protein, 11 aa, Artificial Sequence
  Description of Artificial Sequence: Synthetic peptide
RASQSISSWLA

SEQ ID NO: 1503 - protein, 7 aa, Artificial Sequence
  Description of Artificial Sequence: Synthetic peptide
KASTLES

SEQ ID NO: 1504 - protein, 8 aa, Artificial Sequence
  Description of Artificial Sequence: Synthetic peptide
QQYNTYWT

SEQ ID NO: 1505 - protein, 5 aa, Artificial Sequence
  Description of Artificial Sequence: Synthetic peptide
QYMMM

SEQ ID NO: 1506 - protein, 17 aa, Artificial Sequence
  Description of Artificial Sequence: Synthetic peptide
GISSSGGHTDYADSVKG

SEQ ID NO: 1507 - protein, 13 aa, Artificial Sequence
  Description of Artificial Sequence: Synthetic peptide
RRTGIPRRDAFDI

SEQ ID NO: 1508 - protein, 11 aa, Artificial Sequence
  Description of Artificial Sequence: Synthetic peptide
RASQSISSWLA

SEQ ID NO: 1509 - protein, 7 aa, Artificial Sequence
  Description of Artificial Sequence: Synthetic peptide
KASTLES

SEQ ID NO: 1510 - protein, 8 aa, Artificial Sequence
  Description of Artificial Sequence: Synthetic peptide
QQYNTYWT

SEQ ID NO: 1511 - protein, 5 aa, Artificial Sequence
  Description of Artificial Sequence: Synthetic peptide
VYAMR

SEQ ID NO: 1512 - protein, 17 aa, Artificial Sequence
  Description of Artificial Sequence: Synthetic peptide
SIYPSGGKTWYADSVKG

SEQ ID NO: 1513 - protein, 13 aa, Artificial Sequence
  Description of Artificial Sequence: Synthetic peptide
RRTGIPRRDAFDI

SEQ ID NO: 1514 - protein, 11 aa, Artificial Sequence
  Description of Artificial Sequence: Synthetic peptide
RASQSISSWLA

SEQ ID NO: 1515 - protein, 7 aa, Artificial Sequence
  Description of Artificial Sequence: Synthetic peptide
KASTLES

SEQ ID NO: 1516 - protein, 8 aa, Artificial Sequence
  Description of Artificial Sequence: Synthetic peptide
QQYNTYWT

SEQ ID NO: 1517 - protein, 5 aa, Artificial Sequence
  Description of Artificial Sequence: Synthetic peptide
PYNMM

SEQ ID NO: 1518 - protein, 17 aa, Artificial Sequence
  Description of Artificial Sequence: Synthetic peptide
SIWPSGGTTDYADSVKG

SEQ ID NO: 1519 - protein, 13 aa, Artificial Sequence
  Description of Artificial Sequence: Synthetic peptide
RRTGIPRRDAFDI

SEQ ID NO: 1520 - protein, 11 aa, Artificial Sequence
  Description of Artificial Sequence: Synthetic peptide
RASQSISSWLA

SEQ ID NO: 1521 - protein, 7 aa, Artificial Sequence
  Description of Artificial Sequence: Synthetic peptide
KASTLES

SEQ ID NO: 1522 - protein, 8 aa, Artificial Sequence
  Description of Artificial Sequence: Synthetic peptide
QQYNTYWT

SEQ ID NO: 1523 - protein, 5 aa, Artificial Sequence
  Description of Artificial Sequence: Synthetic peptide
VYSMH

SEQ ID NO: 1524 - protein, 17 aa, Artificial Sequence
  Description of Artificial Sequence: Synthetic peptide
VIGPSGGITLYADSVKG

SEQ ID NO: 1525 - protein, 13 aa, Artificial Sequence
  Description of Artificial Sequence: Synthetic peptide
RRTGIPRRDAFDI

SEQ ID NO: 1526 - protein, 11 aa, Artificial Sequence
  Description of Artificial Sequence: Synthetic peptide
RASQSISSWLA

SEQ ID NO: 1527 - protein, 7 aa, Artificial Sequence
  Description of Artificial Sequence: Synthetic peptide
KASTLES

SEQ ID NO: 1528 - protein, 8 aa, Artificial Sequence
  Description of Artificial Sequence: Synthetic peptide
QQYNTYWT

SEQ ID NO: 1529 - protein, 5 aa, Artificial Sequence
  Description of Artificial Sequence: Synthetic peptide
HYIMM

SEQ ID NO: 1530 - protein, 17 aa, Artificial Sequence
  Description of Artificial Sequence: Synthetic peptide
GIYSSGGITVYADSVKG

SEQ ID NO: 1531 - protein, 13 aa, Artificial Sequence
  Description of Artificial Sequence: Synthetic peptide
RRRGIPRRDAFDI

SEQ ID NO: 1532 - protein, 11 aa, Artificial Sequence
  Description of Artificial Sequence: Synthetic peptide
RASQSISSWLA

SEQ ID NO: 1533 - protein, 7 aa, Artificial Sequence
  Description of Artificial Sequence: Synthetic peptide
KASTLES

SEQ ID NO: 1534 - protein, 8 aa, Artificial Sequence
  Description of Artificial Sequence: Synthetic peptide
QQYNTYWT

SEQ ID NO: 1535 - protein, 5 aa, Artificial Sequence
  Description of Artificial Sequence: Synthetic peptide
HYIMM

SEQ ID NO: 1536 - protein, 17 aa, Artificial Sequence
  Description of Artificial Sequence: Synthetic peptide
GIYSSGGITVYADSVKG

SEQ ID NO: 1537 - protein, 13 aa, Artificial Sequence
  Description of Artificial Sequence: Synthetic peptide
RRMGIPRRNAFDI

SEQ ID NO: 1538 - protein, 11 aa, Artificial Sequence
  Description of Artificial Sequence: Synthetic peptide
RASQSISSWLA

SEQ ID NO: 1539 - protein, 7 aa, Artificial Sequence
  Description of Artificial Sequence: Synthetic peptide
KASTLES

SEQ ID NO: 1540 - protein, 8 aa, Artificial Sequence
  Description of Artificial Sequence: Synthetic peptide
QQYNTYWT

SEQ ID NO: 1541 - protein, 5 aa, Artificial Sequence
  Description of Artificial Sequence: Synthetic peptide
LYVMY

SEQ ID NO: 1542 - protein, 17 aa, Artificial Sequence
  Description of Artificial Sequence: Synthetic peptide
YIVPSGGPTAYADSVKG

SEQ ID NO: 1543 - protein, 13 aa, Artificial Sequence
  Description of Artificial Sequence: Synthetic peptide
RRTGIPRRDAFDI

SEQ ID NO: 1544 - protein, 11 aa, Artificial Sequence
  Description of Artificial Sequence: Synthetic peptide
RASQSISSWLA

SEQ ID NO: 1545 - protein, 7 aa, Artificial Sequence
  Description of Artificial Sequence: Synthetic peptide
KASTLES

SEQ ID NO: 1546 - protein, 8 aa, Artificial Sequence
  Description of Artificial Sequence: Synthetic peptide
QQYNTYWT

SEQ ID NO: 1547 - protein, 5 aa, Artificial Sequence
  Description of Artificial Sequence: Synthetic peptide
PYDML

SEQ ID NO: 1548 - protein, 17 aa, Artificial Sequence
  Description of Artificial Sequence: Synthetic peptide
YIVSSGGLTKYADSVKG

SEQ ID NO: 1549 - protein, 13 aa, Artificial Sequence
  Description of Artificial Sequence: Synthetic peptide
RRTGIPRRDAFDI

SEQ ID NO: 1550 - protein, 11 aa, Artificial Sequence
  Description of Artificial Sequence: Synthetic peptide
RASQSISSWLA

SEQ ID NO: 1551 - protein, 7 aa, Artificial Sequence
  Description of Artificial Sequence: Synthetic peptide
KASTLES

SEQ ID NO: 1552 - protein, 8 aa, Artificial Sequence
  Description of Artificial Sequence: Synthetic peptide
QQYNTYWT

SEQ ID NO: 1553 - protein, 5 aa, Artificial Sequence
  Description of Artificial Sequence: Synthetic peptide
QYTMV

SEQ ID NO: 1554 - protein, 15 aa, Artificial Sequence
  Description of Artificial Sequence: Synthetic peptide
WIYSSRANYADSVKG

SEQ ID NO: 1555 - protein, 13 aa, Artificial Sequence
  Description of Artificial Sequence: Synthetic peptide
RRTGIPRRDAFDI

SEQ ID NO: 1556 - protein, 11 aa, Artificial Sequence
  Description of Artificial Sequence: Synthetic peptide
RASQSISSWLA

SEQ ID NO: 1557 - protein, 7 aa, Artificial Sequence
  Description of Artificial Sequence: Synthetic peptide
KASTLES

SEQ ID NO: 1558 - protein, 8 aa, Artificial Sequence
  Description of Artificial Sequence: Synthetic peptide
QQYNTYWT

SEQ ID NO: 1559 - protein, 5 aa, Artificial Sequence
  Description of Artificial Sequence: Synthetic peptide
HYIMM

SEQ ID NO: 1560 - protein, 17 aa, Artificial Sequence
  Description of Artificial Sequence: Synthetic peptide
GIYSSGGITVYADSVKG

SEQ ID NO: 1561 - protein, 13 aa, Artificial Sequence
  Description of Artificial Sequence: Synthetic peptide
RRTGIPRRDAFDN

SEQ ID NO: 1562 - protein, 11 aa, Artificial Sequence
  Description of Artificial Sequence: Synthetic peptide
RASQSISSWLA

SEQ ID NO: 1563 - protein, 7 aa, Artificial Sequence
  Description of Artificial Sequence: Synthetic peptide
KASTLES

SEQ ID NO: 1564 - protein, 8 aa, Artificial Sequence
  Description of Artificial Sequence: Synthetic peptide
QQYNTYWT

SEQ ID NO: 1565 - protein, 5 aa, Artificial Sequence
  Description of Artificial Sequence: Synthetic peptide
HYIMM

SEQ ID NO: 1566 - protein, 17 aa, Artificial Sequence
  Description of Artificial Sequence: Synthetic peptide
GIYSSGGITVYADSVKG

SEQ ID NO: 1567 - protein, 13 aa, Artificial Sequence
  Description of Artificial Sequence: Synthetic peptide
RRTGIPRWDAFDI

SEQ ID NO: 1568 - protein, 11 aa, Artificial Sequence
  Description of Artificial Sequence: Synthetic peptide
RASQSISSWLA

SEQ ID NO: 1569 - protein, 7 aa, Artificial Sequence
  Description of Artificial Sequence: Synthetic peptide
KASTLES

SEQ ID NO: 1570 - protein, 8 aa, Artificial Sequence
  Description of Artificial Sequence: Synthetic peptide
QQYNTYWT

SEQ ID NO: 1571 - protein, 5 aa, Artificial Sequence
  Description of Artificial Sequence: Synthetic peptide
PYMMM

SEQ ID NO: 1572 - protein, 17 aa, Artificial Sequence
  Description of Artificial Sequence: Synthetic peptide
GIYPSGGYTVYADSVKG

SEQ ID NO: 1573 - protein, 13 aa, Artificial Sequence
  Description of Artificial Sequence: Synthetic peptide
RRTGIPRRDAFDI

SEQ ID NO: 1574 - protein, 11 aa, Artificial Sequence
  Description of Artificial Sequence: Synthetic peptide
RASQSISSWLA

SEQ ID NO: 1575 - protein, 7 aa, Artificial Sequence
  Description of Artificial Sequence: Synthetic peptide
KASTLES

SEQ ID NO: 1576 - protein, 8 aa, Artificial Sequence
  Description of Artificial Sequence: Synthetic peptide
QQYNTYWT

SEQ ID NO: 1577 - protein, 5 aa, Artificial Sequence
  Description of Artificial Sequence: Synthetic peptide
HYIMM

SEQ ID NO: 1578 - protein, 17 aa, Artificial Sequence
  Description of Artificial Sequence: Synthetic peptide
GIYSSGGITVYADSVKG

SEQ ID NO: 1579 - protein, 13 aa, Artificial Sequence
  Description of Artificial Sequence: Synthetic peptide
RRTGIPRRDAFEI

SEQ ID NO: 1580 - protein, 11 aa, Artificial Sequence
  Description of Artificial Sequence: Synthetic peptide
RASQSISSWLA

SEQ ID NO: 1581 - protein, 7 aa, Artificial Sequence
  Description of Artificial Sequence: Synthetic peptide
KASTLES

SEQ ID NO: 1582 - protein, 8 aa, Artificial Sequence
  Description of Artificial Sequence: Synthetic peptide
QQYNTYWT

SEQ ID NO: 1583 - protein, 5 aa, Artificial Sequence
  Description of Artificial Sequence: Synthetic peptide
NYSMD

SEQ ID NO: 1584 - protein, 17 aa, Artificial Sequence
  Description of Artificial Sequence: Synthetic peptide
RIYSSGGGTIYADSVKG

SEQ ID NO: 1585 - protein, 13 aa, Artificial Sequence
  Description of Artificial Sequence: Synthetic peptide
RRTGIPRRDAFDI

SEQ ID NO: 1586 - protein, 11 aa, Artificial Sequence
  Description of Artificial Sequence: Synthetic peptide
RASQSISSWLA

SEQ ID NO: 1587 - protein, 7 aa, Artificial Sequence
  Description of Artificial Sequence: Synthetic peptide
KASTLES

SEQ ID NO: 1588 - protein, 8 aa, Artificial Sequence
  Description of Artificial Sequence: Synthetic peptide
QQYNTYWT

SEQ ID NO: 1589 - protein, 5 aa, Artificial Sequence
  Description of Artificial Sequence: Synthetic peptide
HYVMM

SEQ ID NO: 1590 - protein, 17 aa, Artificial Sequence
  Description of Artificial Sequence: Synthetic peptide
YIVPSGGVTAYADSVKG

SEQ ID NO: 1591 - protein, 13 aa, Artificial Sequence
  Description of Artificial Sequence: Synthetic peptide
RRTGIPRRDAFDI

SEQ ID NO: 1592 - protein, 11 aa, Artificial Sequence
  Description of Artificial Sequence: Synthetic peptide
RASQSISSWLA

SEQ ID NO: 1593 - protein, 7 aa, Artificial Sequence
  Description of Artificial Sequence: Synthetic peptide
KASTLES

SEQ ID NO: 1594 - protein, 8 aa, Artificial Sequence
  Description of Artificial Sequence: Synthetic peptide
QQYNTYWT

SEQ ID NO: 1595 - protein, 5 aa, Artificial Sequence
  Description of Artificial Sequence: Synthetic peptide
HYIMM

SEQ ID NO: 1596 - protein, 17 aa, Artificial Sequence
  Description of Artificial Sequence: Synthetic peptide
GIYSSGGITVYADSVKG

SEQ ID NO: 1597 - protein, 13 aa, Artificial Sequence
  Description of Artificial Sequence: Synthetic peptide
RRTGIPRRDAFDS

SEQ ID NO: 1598 - protein, 11 aa, Artificial Sequence
  Description of Artificial Sequence: Synthetic peptide
RASQSISSWLA

SEQ ID NO: 1599 - protein, 7 aa, Artificial Sequence
  Description of Artificial Sequence: Synthetic peptide
KASTLES

SEQ ID NO: 1600 - protein, 8 aa, Artificial Sequence
  Description of Artificial Sequence: Synthetic peptide
QQYNTYWT

SEQ ID NO: 1601 - protein, 5 aa, Artificial Sequence
  Description of Artificial Sequence: Synthetic peptide
IYLMI

SEQ ID NO: 1602 - protein, 17 aa, Artificial Sequence
  Description of Artificial Sequence: Synthetic peptide
YIGPSGGPTEYADSVKG

SEQ ID NO: 1603 - protein, 13 aa, Artificial Sequence
  Description of Artificial Sequence: Synthetic peptide
RRTGIPRRDAFDI

SEQ ID NO: 1604 - protein, 11 aa, Artificial Sequence
  Description of Artificial Sequence: Synthetic peptide
RASQSISSWLA

SEQ ID NO: 1605 - protein, 7 aa, Artificial Sequence
  Description of Artificial Sequence: Synthetic peptide
KASTLES

SEQ ID NO: 1606 - protein, 8 aa, Artificial Sequence
  Description of Artificial Sequence: Synthetic peptide
QQYNTYWT

SEQ ID NO: 1607 - protein, 5 aa, Artificial Sequence
  Description of Artificial Sequence: Synthetic peptide
YYIMF

SEQ ID NO: 1608 - protein, 17 aa, Artificial Sequence
  Description of Artificial Sequence: Synthetic peptide
YISPSGGYTHYADSVKG

SEQ ID NO: 1609 - protein, 13 aa, Artificial Sequence
  Description of Artificial Sequence: Synthetic peptide
RRTGIPRRDAFDI

SEQ ID NO: 1610 - protein, 11 aa, Artificial Sequence
  Description of Artificial Sequence: Synthetic peptide
RASQSISSWLA

SEQ ID NO: 1611 - protein, 7 aa, Artificial Sequence
  Description of Artificial Sequence: Synthetic peptide
KASTLES

SEQ ID NO: 1612 - protein, 8 aa, Artificial Sequence
  Description of Artificial Sequence: Synthetic peptide
QQYNTYWT

SEQ ID NO: 1613 - protein, 5 aa, Artificial Sequence
  Description of Artificial Sequence: Synthetic peptide
HYIMM

SEQ ID NO: 1614 - protein, 17 aa, Artificial Sequence
  Description of Artificial Sequence: Synthetic peptide
GIYSSGGITVYADSVKG

SEQ ID NO: 1615 - protein, 13 aa, Artificial Sequence
  Description of Artificial Sequence: Synthetic peptide
RRTGIPRRDVFDI

SEQ ID NO: 1616 - protein, 11 aa, Artificial Sequence
  Description of Artificial Sequence: Synthetic peptide
RASQSISSWLA

SEQ ID NO: 1617 - protein, 7 aa, Artificial Sequence
  Description of Artificial Sequence: Synthetic peptide
KASTLES

SEQ ID NO: 1618 - protein, 8 aa, Artificial Sequence
  Description of Artificial Sequence: Synthetic peptide
QQYNTYWT

SEQ ID NO: 1619 - protein, 5 aa, Artificial Sequence
  Description of Artificial Sequence: Synthetic peptide
HYIMM

SEQ ID NO: 1620 - protein, 17 aa, Artificial Sequence
  Description of Artificial Sequence: Synthetic peptide
GIYSSGGITVYADSVKG

SEQ ID NO: 1621 - protein, 13 aa, Artificial Sequence
  Description of Artificial Sequence: Synthetic peptide
RRTGIPRRDSFDI

SEQ ID NO: 1622 - protein, 11 aa, Artificial Sequence
  Description of Artificial Sequence: Synthetic peptide
RASQSISSWLA

SEQ ID NO: 1623 - protein, 7 aa, Artificial Sequence
  Description of Artificial Sequence: Synthetic peptide
KASTLES

SEQ ID NO: 1624 - protein, 8 aa, Artificial Sequence
  Description of Artificial Sequence: Synthetic peptide
QQYNTYWT

SEQ ID NO: 1625 - protein, 5 aa, Artificial Sequence
  Description of Artificial Sequence: Synthetic peptide
TYAMV

SEQ ID NO: 1626 - protein, 17 aa, Artificial Sequence
  Description of Artificial Sequence: Synthetic peptide
SIYPSGGITTYADSVKG

SEQ ID NO: 1627 - protein, 13 aa, Artificial Sequence
  Description of Artificial Sequence: Synthetic peptide
RRTGIPRRDAFDI

SEQ ID NO: 1628 - protein, 11 aa, Artificial Sequence
  Description of Artificial Sequence: Synthetic peptide
RASQSISSWLA

SEQ ID NO: 1629 - protein, 7 aa, Artificial Sequence
  Description of Artificial Sequence: Synthetic peptide
KASTLES

SEQ ID NO: 1630 - protein, 8 aa, Artificial Sequence
  Description of Artificial Sequence: Synthetic peptide
QQYNTYWT

SEQ ID NO: 1631 - protein, 5 aa, Artificial Sequence
  Description of Artificial Sequence: Synthetic peptide
HYIMM

SEQ ID NO: 1632 - protein, 17 aa, Artificial Sequence
  Description of Artificial Sequence: Synthetic peptide
GIYSSGGITVYADSVKG

SEQ ID NO: 1633 - protein, 13 aa, Artificial Sequence
  Description of Artificial Sequence: Synthetic peptide
RRSGIPRRDAFDI

SEQ ID NO: 1634 - protein, 11 aa, Artificial Sequence
  Description of Artificial Sequence: Synthetic peptide
RASQSISSWLA

SEQ ID NO: 1635 - protein, 7 aa, Artificial Sequence
  Description of Artificial Sequence: Synthetic peptide
KASTLES

SEQ ID NO: 1636 - protein, 8 aa, Artificial Sequence
  Description of Artificial Sequence: Synthetic peptide
QQYNTYWT

SEQ ID NO: 1637 - protein, 5 aa, Artificial Sequence
  Description of Artificial Sequence: Synthetic peptide
PYTMI

SEQ ID NO: 1638 - protein, 17 aa, Artificial Sequence
  Description of Artificial Sequence: Synthetic peptide
SISSSGGMTPYADSVKG

SEQ ID NO: 1639 - protein, 13 aa, Artificial Sequence
  Description of Artificial Sequence: Synthetic peptide
RRTGIPRRDAFDI

SEQ ID NO: 1640 - protein, 107 aa, Artificial Sequence; identical to SEQ ID NO: 279
  Description of Artificial Sequence: Synthetic polypeptide

SEQ ID NO: 1641 - protein, 139 aa, Artificial Sequence
  Description of Artificial Sequence: Synthetic polypeptide
EVQLLESGGGLVQPGGSLRLSCAASGFTFSQYMMMWVRQAPGKGLEWVSGISSSGGHTDYADSVKGRFTISRDNSKNTLYLQMNSLRAEDTAVYYCAYRRTGIPRRDAFDIWGQGTMVTVSSASTKGPSVFPLAPSSKS

SEQ ID NO: 1642 - protein, 107 aa, Artificial Sequence; identical to SEQ ID NO: 279
  Description of Artificial Sequence: Synthetic polypeptide

SEQ ID NO: 1643 - protein, 139 aa, Artificial Sequence
  Description of Artificial Sequence: Synthetic polypeptide
EVQLLESGGGLVQPGGSLRLSCAASGFTFSPYMMMWVRQAPGKGLEWVSGIYPSGGYTVYADSVKGRFTISRDNSKNTLYLQMNSLRAEDTAVYYCAYRRTGIPRRDAFDIWGQGTMVTVSSASTKGPSVFPLAPSSKS

SEQ ID NO: 1644 - protein, 107 aa, Artificial Sequence; identical to SEQ ID NO: 279
  Description of Artificial Sequence: Synthetic polypeptide

SEQ ID NO: 1645 - protein, 139 aa, Artificial Sequence
  Description of Artificial Sequence: Synthetic polypeptide
EVQLLESGGGLVQPGGSLRLSCAASGFTFSPYLMWWVRQAPGKGLEWVSYIGPSGGPTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1646 - protein, 107 aa, Artificial Sequence; identical to SEQ ID NO: 279
  Description of Artificial Sequence: Synthetic polypeptide

SEQ ID NO: 1647 - protein, 139 aa, Artificial Sequence
  Description of Artificial Sequence: Synthetic polypeptide
EVQLLESGGGLVQPGGSLRLSCAASGFTFSKYWMYWVRQAPGKGLEWVSYIRPSGGQTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1648 - protein, 107 aa, Artificial Sequence; identical to SEQ ID NO: 279
  Description of Artificial Sequence: Synthetic polypeptide

SEQ ID NO: 1649 - protein, 138 aa, Artificial Sequence
  Description of Artificial Sequence: Synthetic polypeptide
EVQLLESGGGLVQPGGSLRLSCAASGFTFSMYQMFWVRQAPGKGLEWVSSISPGGGTQYADSVKGRFTISRDNSKNTLYLQMNSLRAEDTAVYYCAYRRTGIPRRDAFDIWGQGTMVTVSSASTKGPSVFPLAPSSKS

SEQ ID NO: 1650 - protein, 107 aa, Artificial Sequence; identical to SEQ ID NO: 279
  Description of Artificial Sequence: Synthetic polypeptide

SEQ ID NO: 1651 - protein, 139 aa, Artificial Sequence
  Description of Artificial Sequence: Synthetic polypeptide
EVQLLESGGGLVQPGGSLRLSCAASGFTFSIYGMFWVRQAPGKGLEWVSGIGPSGGPTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1652 - protein, 107 aa, Artificial Sequence; identical to SEQ ID NO: 279
  Description of Artificial Sequence: Synthetic polypeptide

SEQ ID NO: 1653 - protein, 139 aa, Artificial Sequence
  Description of Artificial Sequence: Synthetic polypeptide
EVQLLESGGGLVQPGGSLRLSCAASGFTFSYYIMFWVRQAPGKGLEWVSYISPSGGYTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1654 - protein, 107 aa, Artificial Sequence; identical to SEQ ID NO: 279
  Description of Artificial Sequence: Synthetic polypeptide

SEQ ID NO: 1655 - protein, 139 aa, Artificial Sequence
  Description of Artificial Sequence: Synthetic polypeptide
EVQLLESGGGLVQPGGSLRLSCAASGFTFSHYVMMWVRQAPGKGLEWVSYIVPSGGVTAYADSVKGRFTISRDNSKNTLYLQMNSLRAEDTAVYYCAYRRTGIPRRDAFDIWGQGTMVTVSSASTKGPSVFPLAPSSKS

SEQ ID NO: 1656 - protein, 107 aa, Artificial Sequence; identical to SEQ ID NO: 279
  Description of Artificial Sequence: Synthetic polypeptide

SEQ ID NO: 1657 - protein, 139 aa, Artificial Sequence
  Description of Artificial Sequence: Synthetic polypeptide
EVQLLESGGGLVQPGGSLRLSCAASGFTFSPYNMMWVRQAPGKGLEWVSSIWPSGGTTDYADSVKGRFTISRDNSKNTLYLQMNSLRAEDTAVYYCAYRRTGIPRRDAFDIWGQGTMVTVSSASTKGPSVFPLAPSSKS

SEQ ID NO: 1658 - protein, 107 aa, Artificial Sequence; identical to SEQ ID NO: 279
  Description of Artificial Sequence: Synthetic polypeptide

SEQ ID NO: 1659 - protein, 139 aa, Artificial Sequence
  Description of Artificial Sequence: Synthetic polypeptide
EVQLLESGGGLVQPGGSLRLSCAASGFTFSIYSMHWVRQAPGKGLEWVSSIYPSRGMTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1660 - protein, 107 aa, Artificial Sequence; identical to SEQ ID NO: 279
  Description of Artificial Sequence: Synthetic polypeptide

SEQ ID NO: 1661 - protein, 139 aa, Artificial Sequence
  Description of Artificial Sequence: Synthetic polypeptide
EVQLLESGGGLVQPGGSLRLSCAASGFTFSVYSMHWVRQAPGKGLEWVSVIGPSGGITLYADSVKGRFTISRDNSKNTLYLQMNSLRAEDTAVYYCAYRRTGIPRRDAFDIWGQGTMVTVSSASTKGPSVFPLAPSSKS

SEQ ID NO: 1662 - protein, 107 aa, Artificial Sequence; identical to SEQ ID NO: 279
  Description of Artificial Sequence: Synthetic polypeptide

SEQ ID NO: 1663 - protein, 139 aa, Artificial Sequence
  Description of Artificial Sequence: Synthetic polypeptide
EVQLLESGGGLVQPGGSLRLSCAASGFTFSRYSMRWVRQAPGKGLEWVSVIYPSGGQTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1664 - protein, 107 aa, Artificial Sequence; identical to SEQ ID NO: 279
  Description of Artificial Sequence: Synthetic polypeptide

SEQ ID NO: 1665 - protein, 139 aa, Artificial Sequence
  Description of Artificial Sequence: Synthetic polypeptide
EVQLLESGGGLVQPGGSLRLSCAASGFTFSNYSMDWVRQAPGKGLEWVSRIYSSGGGTIYADSVKGRFTISRDNSKNTLYLQMNSLRAEDTAVYYCAYRRTGIPRRDAFDIWGQGTMVTVSSASTKGPSVFPLAPSSKS

SEQ ID NO: 1666 - protein, 107 aa, Artificial Sequence; identical to SEQ ID NO: 279
  Description of Artificial Sequence: Synthetic polypeptide

SEQ ID NO: 1667 - protein, 138 aa, Artificial Sequence
  Description of Artificial Sequence: Synthetic polypeptide
EVQLLESGGGLVQPGGSLRLSCAASGFTFSRYVMWWVRQAPGKGLEWVSSISPSGDTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1668 - protein, 107 aa, Artificial Sequence; identical to SEQ ID NO: 279
  Description of Artificial Sequence: Synthetic polypeptide

SEQ ID NO: 1669 - protein, 139 aa, Artificial Sequence
  Description of Artificial Sequence: Synthetic polypeptide
EVQLLESGGGLVQPGGSLRLSCAASGFTFSIYDMIWVRQAPGKGLEWVSSIYPSGGNTSYADSVKGRFTISRDNSKNTLYLQMNSLRAEDTAVYYCAYRRTGIPRRDAFDIWGQGTMVTVSSASTKGPSVFPLAPSSKS

SEQ ID NO: 1670 - protein, 107 aa, Artificial Sequence; identical to SEQ ID NO: 279
  Description of Artificial Sequence: Synthetic polypeptide

SEQ ID NO: 1671 - protein, 139 aa, Artificial Sequence
  Description of Artificial Sequence: Synthetic polypeptide
EVQLLESGGGLVQPGGSLRLSCAASGFTFSIYSMQWVRQAPGKGLEWVSSIGSSGGKTLYADSVKGRFTISRDNSKNTLYLQMNSLRAEDTAVYYCAYRRTGIPRRDAFDIWGQGTMVTVSSASTKGPSVFPLAPSSKS

SEQ ID NO: 1672 - protein, 107 aa, Artificial Sequence; identical to SEQ ID NO: 279
  Description of Artificial Sequence: Synthetic polypeptide

SEQ ID NO: 1673 - protein, 139 aa, Artificial Sequence
  Description of Artificial Sequence: Synthetic polypeptide
EVQLLESGGGLVQPGGSLRLSCAASGFTFSVYNMHWVRQAPGKGLEWVSSIYPSGGMTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1674 - protein, 107 aa, Artificial Sequence; identical to SEQ ID NO: 279
  Description of Artificial Sequence: Synthetic polypeptide

SEQ ID NO: 1675 - protein, 139 aa, Artificial Sequence
  Description of Artificial Sequence: Synthetic polypeptide
EVQLLESGGGLVQPGGSLRLSCAASGFTFSPYDMLWVRQAPGKGLEWVSYIVSSGGLTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1676 - protein, 107 aa, Artificial Sequence; identical to SEQ ID NO: 279
  Description of Artificial Sequence: Synthetic polypeptide

SEQ ID NO: 1677 - protein, 139 aa, Artificial Sequence
  Description of Artificial Sequence: Synthetic polypeptide
EVQLLESGGGLVQPGGSLRLSCAASGFTFSTYTMRWVRQAPGKGLEWVSSIYPSGGKTQYADSVKGRFTISRDNSKNTLYLQMNSLRAEDTAVYYCAYRRTGIPRRDAFDIWGQGTMVTVSSASTKGPSVFPLAPSSKS

SEQ ID NO: 1678 - protein, 107 aa, Artificial Sequence; identical to SEQ ID NO: 279
  Description of Artificial Sequence: Synthetic polypeptide

SEQ ID NO: 1679 - protein, 139 aa, Artificial Sequence
  Description of Artificial Sequence: Synthetic polypeptide
EVQLLESGGGLVQPGGSLRLSCAASGFTFSIYHMYWVRQAPGKGLEWVSSIGPSGGPTGYADSVKGRFTISRDNSKNTLYLQMNSLRAEDTAVYYCAYRRTGIPRRDAFDIWGQGTMVTVSSASTKGPSVFPLAPSSKS

SEQ ID NO: 1680 - protein, 107 aa, Artificial Sequence; identical to SEQ ID NO: 279
  Description of Artificial Sequence: Synthetic polypeptide

SEQ ID NO: 1681 - protein, 139 aa, Artificial Sequence
  Description of Artificial Sequence: Synthetic polypeptide
EVQLLESGGGLVQPGGSLRLSCAASGFTFSIYSMFWVRQAPGKGLEWVSSIGPSGGVTHYADSVKGRFTISRDNSKNTLYLQMNSLRAEDTAVYYCAYRRTGIPRRDAFDIWGQGTMVTVSSASTKGPSVFPLAPSSKS

SEQ ID NO: 1682 - protein, 107 aa, Artificial Sequence; identical to SEQ ID NO: 279
  Description of Artificial Sequence: Synthetic polypeptide

SEQ ID NO: 1683 - protein, 139 aa, Artificial Sequence
  Description of Artificial Sequence: Synthetic polypeptide
EVQLLESGGGLVQPGGSLRLSCAASGFTFSVYAMRWVRQAPGKGLEWVSSIYPSGGKTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1684 - protein, 107 aa, Artificial Sequence; identical to SEQ ID NO: 279
  Description of Artificial Sequence: Synthetic polypeptide

SEQ ID NO: 1685 - protein, 139 aa, Artificial Sequence
  Description of Artificial Sequence: Synthetic polypeptide
EVQLLESGGGLVQPGGSLRLSCAASGFTFSTYAMVWVRQAPGKGLEWVSSIYPSGGITTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1686 - protein, 107 aa, Artificial Sequence; identical to SEQ ID NO: 279
  Description of Artificial Sequence: Synthetic polypeptide

SEQ ID NO: 1687 - protein, 139 aa, Artificial Sequence
  Description of Artificial Sequence: Synthetic polypeptide
EVQLLESGGGLVQPGGSLRLSCAASGFTFSSYNMHWVRQAPGKGLEWVSSIVPSGGKTNYADSVKGRFTISRDNSKNTLYLQMNSLRAEDTAVYYCAYRRTGIPRRDAFDIWGQGTMVTVSSASTKGPSVFPLAPSSKS

SEQ ID NO: 1688 - protein, 107 aa, Artificial Sequence; identical to SEQ ID NO: 279
  Description of Artificial Sequence: Synthetic polypeptide

SEQ ID NO: 1689 - protein, 139 aa, Artificial Sequence
  Description of Artificial Sequence: Synthetic polypeptide
EVQLLESGGGLVQPGGSLRLSCAASGFTFSIYNMIWVRQAPGKGLEWVSSIYPSGGWTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1690 - protein, 107 aa, Artificial Sequence; identical to SEQ ID NO: 279
  Description of Artificial Sequence: Synthetic polypeptide

SEQ ID NO: 1691 - protein, 139 aa, Artificial Sequence
  Description of Artificial Sequence: Synthetic polypeptide
EVQLLESGGGLVQPGGSLRLSCAASGFTFSPYTMIWVRQAPGKGLEWVSSISSSGGMTPYADSVKGRFTISRDNSKNTLYLQMNSLRAEDTAVYYCAYRRTGIPRRDAFDIWGQGTMVTVSSASTKGPSVFPLAPSSKS

SEQ ID NO: 1692 - protein, 107 aa, Artificial Sequence; identical to SEQ ID NO: 279
  Description of Artificial Sequence: Synthetic polypeptide

SEQ ID NO: 1693 - protein, 139 aa, Artificial Sequence
  Description of Artificial Sequence: Synthetic polypeptide
EVQLLESGGGLVQPGGSLRLSCAASGFTFSRYSMIWVRQAPGKGLEWVSSIWSSGGATEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1694 - protein, 107 aa, Artificial Sequence; identical to SEQ ID NO: 279
  Description of Artificial Sequence: Synthetic polypeptide

SEQ ID NO: 1695 - protein, 139 aa, Artificial Sequence
  Description of Artificial Sequence: Synthetic polypeptide
EVQLLESGGGLVQPGGSLRLSCAASGFTFSIYSMHWVRQAPGKGLEWVSSIYSSGGPTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1696 - protein, 107 aa, Artificial Sequence; identical to SEQ ID NO: 279
  Description of Artificial Sequence: Synthetic polypeptide

SEQ ID NO: 1697 - protein, 139 aa, Artificial Sequence
  Description of Artificial Sequence: Synthetic polypeptide
EVQLLESGGGLVQPGGSLRLSCAASGFTFSRYQMHWVRQAPGKGLEWVSWISPSGGITGYADSVKGRFTISRDNSKNTLYLQMNSLRAEDTAVYYCAYRRTGIPRRDAFDIWGQGTMVTVSSASTKGPSVFPLAPSSKS

SEQ ID NO: 1698 - protein, 107 aa, Artificial Sequence; identical to SEQ ID NO: 279
  Description of Artificial Sequence: Synthetic polypeptide

SEQ ID NO: 1699 - protein, 138 aa, Artificial Sequence
  Description of Artificial Sequence: Synthetic polypeptide
EVQLLESGGGLVQPGGSLRLSCAASGFTFSWYMMQWVRQAPGKGLEWVSRISPSGGTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1700 - protein, 107 aa, Artificial Sequence; identical to SEQ ID NO: 279
  Description of Artificial Sequence: Synthetic polypeptide

SEQ ID NO: 1701 - protein, 139 aa, Artificial Sequence
  Description of Artificial Sequence: Synthetic polypeptide
EVQLLESGGGLVQPGGSLRLSCAASGFTFSIYFMSWVRQAPGKGLEWVSSIRSSGGPTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1702 - protein, 107 aa, Artificial Sequence; identical to SEQ ID NO: 279
  Description of Artificial Sequence: Synthetic polypeptide

SEQ ID NO: 1703 - protein, 139 aa, Artificial Sequence
  Description of Artificial Sequence: Synthetic polypeptide
EVQLLESGGGLVQPGGSLRLSCAASGFTFSVYSMTWVRQAPGKGLEWVSSIGSSGGSTTYADSVKGRFTISRDNSKNTLYLQMNSLRAEDTAVYYCAYRRTGIPRRDAFDIWGQGTMVTVSSASTKGPSVFPLAPSSKS

SEQ ID NO: 1704 - protein, 107 aa, Artificial Sequence; identical to SEQ ID NO: 279
  Description of Artificial Sequence: Synthetic polypeptide

SEQ ID NO: 1705 - protein, 139 aa, Artificial Sequence
  Description of Artificial Sequence: Synthetic polypeptide
EVQLLESGGGLVQPGGSLRLSCAASGFTFSKYSMAWVRQAPGKGLEWVSGIYPSGGRTLYADSVKGRFTISRDNSKNTLYLQMNSLRAEDTAVYYCAYRRTGIPRRDAFDIWGQGTMVTVSSASTKGPSVFPLAPSSKS

SEQ ID NO: 1706 - protein, 107 aa, Artificial Sequence; identical to SEQ ID NO: 279
  Description of Artificial Sequence: Synthetic polypeptide

SEQ ID NO: 1707 - protein, 139 aa, Artificial Sequence
  Description of Artificial Sequence: Synthetic polypeptide
EVQLLESGGGLVQPGGSLRLSCAASGFTFSRYSMSWVRQAPGKGLEWVSGISPSGGETSYADSVKGRFTISRDNSKNTLYLQMNSLRAEDTAVYYCAYRRTGIPRRDAFDIWGQGTMVTVSSASTKGPSVFPLAPSSKS

SEQ ID NO: 1708 - protein, 107 aa, Artificial Sequence; identical to SEQ ID NO: 279
  Description of Artificial Sequence: Synthetic polypeptide

SEQ ID NO: 1709 - protein, 139 aa, Artificial Sequence
  Description of Artificial Sequence: Synthetic polypeptide
EVQLLESGGGLVQPGGSLRLSCAASGFTFSRYKMYWVRQAPGKGLEWVSVIGPSGGATFYADSVKGRFTISRDNSKNTLYLQMNSLRAEDTAVYYCAYRRTGIPRRDAFDIWGQGTMVTVSSASTKGPSVFPLAPSSKS

SEQ ID NO: 1710 - protein, 107 aa, Artificial Sequence; identical to SEQ ID NO: 279
  Description of Artificial Sequence: Synthetic polypeptide

SEQ ID NO: 1711 - protein, 139 aa, Artificial Sequence
  Description of Artificial Sequence: Synthetic polypeptide
EVQLLESGGGLVQPGGSLRLSCAASGFTFSQYFMHWVRQAPGKGLEWVSYIYPSGGMTEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1712 - protein, 107 aa, Artificial Sequence; identical to SEQ ID NO: 279
  Description of Artificial Sequence: Synthetic polypeptide

SEQ ID NO: 1713 - protein, 139 aa, Artificial Sequence
  Description of Artificial Sequence: Synthetic polypeptide
EVQLLESGGGLVQPGGSLRLSCAASGFTFSIYTMYWVRQAPGKGLEWVSSISPSGGWTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1714 - protein, 107 aa, Artificial Sequence; identical to SEQ ID NO: 279
  Description of Artificial Sequence: Synthetic polypeptide

SEQ ID NO: 1715 - protein, 140 aa, Artificial Sequence
  Description of Artificial Sequence: Synthetic polypeptide
EVQLLESGGGLVQPGGSLRLSCAASGFTFSHYMGMNWVRQAPGKGLEWVSSIVPSGGWTQYADSVKGRFTISRDNSKNTLYLQMNSLRAEDTAVYYCAYRRTGIPRRDAFDIWGQGTMVTVSSASTKGPSVFPLAPSSKS

SEQ ID NO: 1716 - protein, 107 aa, Artificial Sequence; identical to SEQ ID NO: 279
  Description of Artificial Sequence: Synthetic polypeptide

SEQ ID NO: 1717 - protein, 139 aa, Artificial Sequence
  Description of Artificial Sequence: Synthetic polypeptide
EVQLLESGGGLVQPGGSLRLSCAASGFTFSLYVMYWVRQAPGKGLEWVSYIVPSGGPTAYADSVKGRFTISRDNSKNTLYLQMNSLRAEDTAVYYCAYRRTGIPRRDAFDIWGQGTMVTVSSASTKGPSVFPLAPSSKS

SEQ ID NO: 1718 - protein, 107 aa, Artificial Sequence; identical to SEQ ID NO: 279
  Description of Artificial Sequence: Synthetic polypeptide

SEQ ID NO: 1719 - protein, 139 aa, Artificial Sequence
  Description of Artificial Sequence: Synthetic polypeptide
EVQLLESGGGLVQPGGSLRLSCAASGFTFSIYSMYWVRQAPGKGLEWVSYIRPSGGNTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1720 - protein, 107 aa, Artificial Sequence; identical to SEQ ID NO: 279
  Description of Artificial Sequence: Synthetic polypeptide

SEQ ID NO: 1721 - protein, 139 aa, Artificial Sequence
  Description of Artificial Sequence: Synthetic polypeptide
EVQLLESGGGLVQPGGSLRLSCAASGFTFSIYDMNWVRQAPGKGLEWVSSIYPSGGRTRYADSVKGRFTISRDNSKNTLYLQMNSLRAEDTAVYYCAYRRTGIPRRDAFDIWGQGTMVTVSSASTKGPSVFPLAPSSKS

SEQ ID NO: 1722 - protein, 107 aa, Artificial Sequence; identical to SEQ ID NO: 279
  Description of Artificial Sequence: Synthetic polypeptide

SEQ ID NO: 1723 - protein, 139 aa, Artificial Sequence
  Description of Artificial Sequence: Synthetic polypeptide
EVQLLESGGGLVQPGGSLRLSCAASGFTFSTYSMYWVRQAPGKGLEWVSSIYPSGGLTWYADSVKGRFTISRDNSKNTLYLQMNSLRAEDTAVYYCAYRRTGIPRRDAFDIWGQGTMVTVSSASTKGPSVFPLAPSSKS

SEQ ID NO: 1724 - protein, 107 aa, Artificial Sequence; identical to SEQ ID NO: 279
  Description of Artificial Sequence: Synthetic polypeptide

SEQ ID NO: 1725 - protein, 139 aa, Artificial Sequence
  Description of Artificial Sequence: Synthetic polypeptide
EVQLLESGGGLVQPGGSLRLSCAASGFTFSIYDMWWVRQAPGKGLEWVSSIRPSGGITKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1726 - protein, 107 aa, Artificial Sequence; identical to SEQ ID NO: 279
  Description of Artificial Sequence: Synthetic polypeptide

SEQ ID NO: 1727 - protein, 139 aa, Artificial Sequence
  Description of Artificial Sequence: Synthetic polypeptide
EVQLLESGGGLVQPGGSLRLSCAASGFTFSVYSMWWVRQAPGKGLEWVSSISSSGGMTEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1728 - protein, 107 aa, Artificial Sequence; identical to SEQ ID NO: 279
  Description of Artificial Sequence: Synthetic polypeptide

SEQ ID NO: 1729 - protein, 139 aa, Artificial Sequence
  Description of Artificial Sequence: Synthetic polypeptide
EVQLLESGGGLVQPGGSLRLSCAASGFTFSVYNMHWVRQAPGKGLEWVSSIYPSGGMTYYADSVKGRFTISRDNSKNTLYLQMNSLRAEDTAVYYCAYRRTGIPRRDAFDIWGQGTMVTVSSASTKGPSVFPLAPSSKS

SEQ ID NO: 1730 - protein, 107 aa, Artificial Sequence; identical to SEQ ID NO: 279
  Description of Artificial Sequence: Synthetic polypeptide

SEQ ID NO: 1731 - protein, 139 aa, Artificial Sequence
  Description of Artificial Sequence: Synthetic polypeptide
EVQLLESGGGLVQPGGSLRLSCAASGFTFSIYTMMWVRQAPGKGLEWVSSIWSSGGQTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1732 - protein, 107 aa, Artificial Sequence; identical to SEQ ID NO: 279
  Description of Artificial Sequence: Synthetic polypeptide

SEQ ID NO: 1733 - protein, 137 aa, Artificial Sequence
  Description of Artificial Sequence: Synthetic polypeptide
EVQLLESGGGLVQPGGSLRLSCAASGFTFSQYTMVWVRQAPGKGLEWVSWIYSSRANYADSVKGRFTISRDNSKNTLYLQMNSLRAEDTAVYYCAYRRTGIPRRDAFDIWGQGTMVTVSSASTKGPSVFPLAPSSKS

SEQ ID NO: 1734 - protein, 107 aa, Artificial Sequence; identical to SEQ ID NO: 279
  Description of Artificial Sequence: Synthetic polypeptide

SEQ ID NO: 1735 - protein, 139 aa, Artificial Sequence
  Description of Artificial Sequence: Synthetic polypeptide
EVQLLESGGGLVQPGGSLRLSCAASGFTFSIYDMTWVRQAPGKGLEWVSSIYPSGGQTIYADSVKGRFTISRDNSKNTLYLQMNSLRAEDTAVYYCAYRRTGIPRRDAFDIWGQGTMVTVSSASTKGPSVFPLAPSSKS

SEQ ID NO: 1736 - protein, 107 aa, Artificial Sequence; identical to SEQ ID NO: 279
  Description of Artificial Sequence: Synthetic polypeptide

SEQ ID NO: 1737 - protein, 138 aa, Artificial Sequence
  Description of Artificial Sequence: Synthetic polypeptide
EVQLLESGGGLVQPGGSLRLSCAASGFTFSPYNMYWVRQAPGKGLEWVSWIVPGGVTKYADSVKGRFTISRDNSKNTLYLQMNSLRAEDTAVYYCAYRRTGIPRRDAFDIWGQGTMVTVSSASTKGPSVFPLAPSSKS

SEQ ID NO: 1738 - protein, 107 aa, Artificial Sequence; identical to SEQ ID NO: 279
  Description of Artificial Sequence: Synthetic polypeptide

SEQ ID NO: 1739 - protein, 139 aa, Artificial Sequence
  Description of Artificial Sequence: Synthetic polypeptide
EVQLLESGGGLVQPGGSLRLSCAASGFTFSIYDMYWVRQAPGKGLEWVSSIGPSGGPTAYADSVKGRFTISRDNSKNTLYLQMNSLRAEDTAVYYCAYRRTGIPRRDAFDIWGQGTMVTVSSASTKGPSVFPLAPSSKS

SEQ ID NO: 1740 - protein, 107 aa, Artificial Sequence; identical to SEQ ID NO: 279
  Description of Artificial Sequence: Synthetic polypeptide

SEQ ID NO: 1741 - protein, 139 aa, Artificial Sequence
  Description of Artificial Sequence: Synthetic polypeptide
EVQLLESGGGLVQPGGSLRLSCAASGFTFSIYLMIWVRQAPGKGLEWVSYIGPSGGPTEYADSVKGRFTISRDNSKNTLYLQMNSLRAEDTAVYYCAYRRTGIPRRDAFDIWGQGTMVTVSSASTKGPSVFPLAPSSKS

SEQ ID NO: 1742 - protein, 107 aa, Artificial Sequence; identical to SEQ ID NO: 279
  Description of Artificial Sequence: Synthetic polypeptide

SEQ ID NO: 1743 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKS

SEQ ID NO: 1744 - protein, 107 aa, Artificial Sequence; identical to SEQ ID NO: 279
  Description of Artificial Sequence: Synthetic polypeptide

SEQ ID NO: 1745 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRRGIPRRDAFDIWGQGTMVTVSSASTKGPSVFPLAPSSKS

SEQ ID NO: 1746 - protein, 107 aa, Artificial Sequence; identical to SEQ ID NO: 279
  Description of Artificial Sequence: Synthetic polypeptide

SEQ ID NO: 1747 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGIPRRDAFDNWGQGTMVTVSSASTKGPSVFPLAPSSKS

SEQ ID NO: 1748 - protein, 107 aa, Artificial Sequence; identical to SEQ ID NO: 279
  Description of Artificial Sequence: Synthetic polypeptide

SEQ ID NO: 1749 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDSFDIWGQGTMVTVSSASTKGPSVFPLAPSSKS

SEQ ID NO: 1750 - protein, 107 aa, Artificial Sequence; identical to SEQ ID NO: 279
  Description of Artificial Sequence: Synthetic polypeptide

SEQ ID NO: 1751 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDAFDSWGQGTMVTVSSASTKGPSVFPLAPSSKS

SEQ ID NO: 1752 - protein, 107 aa, Artificial Sequence; identical to SEQ ID NO: 279
  Description of Artificial Sequence: Synthetic polypeptide

SEQ ID NO: 1753 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAWRRIGVPRRDSFDMWGQGTMVTVSSASTKGPSVFPLAPSSKS

SEQ ID NO: 1754 - protein, 107 aa, Artificial Sequence; identical to SEQ ID NO: 279
  Description of Artificial Sequence: Synthetic polypeptide

SEQ ID NO: 1755 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDAFDNWGQGTMVTVSSASTKGPSVFPLAPSSKS

SEQ ID NO: 1756 - protein, 107 aa, Artificial Sequence; identical to SEQ ID NO: 279
  Description of Artificial Sequence: Synthetic polypeptide

SEQ ID NO: 1757 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRMGIPRRNAFDIWGQGTMVTVSSASTKGPSVFPLAPSSKS

SEQ ID NO: 1758 - protein, 107 aa, Artificial Sequence; identical to SEQ ID NO: 279
  Description of Artificial Sequence: Synthetic polypeptide

SEQ ID NO: 1759 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRNAFDNWGQGTMVTVSSASTKGPSVFPLAPSSKS

SEQ ID NO: 1760 - protein, 107 aa, Artificial Sequence; identical to SEQ ID NO: 279
  Description of Artificial Sequence: Synthetic polypeptide

SEQ ID NO: 1761 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDVFDIWGQGTMVTVSSASTKGPSVFPLAPSSKS

SEQ ID NO: 1762 - protein, 107 aa, Artificial Sequence; identical to SEQ ID NO: 279
  Description of Artificial Sequence: Synthetic polypeptide

SEQ ID NO: 1763 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDEFDIWGQGTMVTVSSASTKGPSVFPLAPSSKS

SEQ ID NO: 1764 - protein, 107 aa, Artificial Sequence; identical to SEQ ID NO: 279
  Description of Artificial Sequence: Synthetic polypeptide

SEQ ID NO: 1765 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRSGIPRRDAFDIWGQGTMVTVSSASTKGPSVFPLAPSSKS

SEQ ID NO: 1766 - protein, 107 aa, Artificial Sequence; identical to SEQ ID NO: 279
  Description of Artificial Sequence: Synthetic polypeptide

SEQ ID NO: 1767 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDAFDIWGQGTMVTVSSASTKGPSVFPLAPSSKS

SEQ ID NO: 1768 - protein, 107 aa, Artificial Sequence; identical to SEQ ID NO: 279
  Description of Artificial Sequence: Synthetic polypeptide

SEQ ID NO: 1769 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDALDNWGQGTMVTVSSASTKGPSVFPLAPSSKS

SEQ ID NO: 1770 - protein, 107 aa, Artificial Sequence; identical to SEQ ID NO: 279
  Description of Artificial Sequence: Synthetic polypeptide

SEQ ID NO: 1771 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDAFDIWGQGTMVTVSSASTKGPSVFPLAPSSKS

SEQ ID NO: 1772 - protein, 107 aa, Artificial Sequence; identical to SEQ ID NO: 279
  Description of Artificial Sequence: Synthetic polypeptide

SEQ ID NO: 1773 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRKGIPRRDDFDIWGQGTMVTVSSASTKGPSVFPLAPSSKS

SEQ ID NO: 1774 - protein, 107 aa, Artificial Sequence; identical to SEQ ID NO: 279
  Description of Artificial Sequence: Synthetic polypeptide

SEQ ID NO: 1775 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRWDAFDIWGQGTMVTVSSASTKGPSVFPLAPSSKS

SEQ ID NO: 1776 - protein, 107 aa, Artificial Sequence; identical to SEQ ID NO: 279
  Description of Artificial Sequence: Synthetic polypeptide

SEQ ID NO: 1777 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGIPRRDSFDIWGQGTMVTVSSASTKGPSVFPLAPSSKS

SEQ ID NO: 1778 - protein, 107 aa, Artificial Sequence; identical to SEQ ID NO: 279
  Description of Artificial Sequence: Synthetic polypeptide

SEQ ID NO: 1779 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYQRTGVPRRDSFNIWGQGTMVTVSSASTKGPSVFPLAPSSKS

SEQ ID NO: 1780 - protein, 107 aa, Artificial Sequence; identical to SEQ ID NO: 279
  Description of Artificial Sequence: Synthetic polypeptide

SEQ ID NO: 1781 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDDFDIWGQGTMVTVSSASTKGPSVFPLAPSSKS

SEQ ID NO: 1782 - protein, 107 aa, Artificial Sequence; identical to SEQ ID NO: 279
  Description of Artificial Sequence: Synthetic polypeptide

SEQ ID NO: 1783 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRSGVPRRDDFDIWGQGTMVTVSSASTKGPSVFPLAPSSKS

SEQ ID NO: 1784 - protein, 107 aa, Artificial Sequence; identical to SEQ ID NO: 279
  Description of Artificial Sequence: Synthetic polypeptide

SEQ ID NO: 1785 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRWDDFDIWGQGTMVTVSSASTKGPSVFPLAPSSKS

SEQ ID NO: 1786 - protein, 107 aa, Artificial Sequence; identical to SEQ ID NO: 279
  Description of Artificial Sequence: Synthetic polypeptide

SEQ ID NO: 1787 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRPGVPRRDAFDIWGQGTMVTVSSASTKGPSVFPLAPSSKS

SEQ ID NO: 1788 - protein, 107 aa, Artificial Sequence; identical to SEQ ID NO: 279
  Description of Artificial Sequence: Synthetic polypeptide

SEQ ID NO: 1789 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDDFDIWGQGTMVTVSSASTKGPSVFPLAPSSKS

SEQ ID NO: 1790 - protein, 107 aa, Artificial Sequence; identical to SEQ ID NO: 279
  Description of Artificial Sequence: Synthetic polypeptide

SEQ ID NO: 1791 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDSFDIWGQGTMVTVSSASTKGPSVFPLAPSSKS

SEQ ID NO: 1792 - protein, 107 aa, Artificial Sequence; identical to SEQ ID NO: 279
  Description of Artificial Sequence: Synthetic polypeptide

SEQ ID NO: 1793 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDAFEIWGQGTMVTVSSASTKGPSVFPLAPSSKS

SEQ ID NO: 1794 - protein, 107 aa, Artificial Sequence; identical to SEQ ID NO: 279
  Description of Artificial Sequence: Synthetic polypeptide

SEQ ID NO: 1795 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRRGVPRRDDFDIWGQGTMVTVSSASTKGPSVFPLAPSSKS

SEQ ID NO: 1796 - protein, 107 aa, Artificial Sequence; identical to SEQ ID NO: 279
  Description of Artificial Sequence: Synthetic polypeptide

SEQ ID NO: 1797 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRWDAFDIWGQGTMVTVSSASTKGPSVFPLAPSSKS

SEQ ID NO: 1798 - protein, 107 aa, Artificial Sequence; identical to SEQ ID NO: 279
  Description of Artificial Sequence: Synthetic polypeptide

SEQ ID NO: 1799 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGVPRRDSFEIWGQGTMVTVSSASTKGPSVFPLAPSSKS

SEQ ID NO: 1800 - protein, 107 aa, Artificial Sequence; identical to SEQ ID NO: 279
  Description of Artificial Sequence: Synthetic polypeptide

SEQ ID NO: 1801 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGVPRWDDFDIWGQGTMVTVSSASTKGPSVFPLAPSSKS

SEQ ID NO: 1802 - protein, 107 aa, Artificial Sequence; identical to SEQ ID NO: 279
  Description of Artificial Sequence: Synthetic polypeptide

SEQ ID NO: 1803 - protein, 139 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAFRRTGVPRRDVFDIWGQGTMVTVSSASTKGPSVFPLAPSSKS

SEQ ID NO: 1804 - protein, 12 aa, Artificial Sequence
  Description of Artificial Sequence: Synthetic peptide
RTSQFVNSNYLA

SEQ ID NO: 1805 - protein, 7 aa, Artificial Sequence
  Description of Artificial Sequence: Synthetic peptide
GASSRAT

SEQ ID NO: 1806 - protein, 9 aa, Artificial Sequence
  Description of Artificial Sequence: Synthetic peptide
QQSSRTPWT

SEQ ID NO: 1807 - protein, 5 aa, Artificial Sequence
  Description of Artificial Sequence: Synthetic peptide
HYLMT

SEQ ID NO: 1808 - protein, 17 aa, Artificial Sequence
  Description of Artificial Sequence: Synthetic peptide
YISPSGGHTIYADSVKG

SEQ ID NO: 1809 - protein, 16 aa, Artificial Sequence
  Description of Artificial Sequence: Synthetic peptide
VARGIAARSRTSYLDQ

SEQ ID NO: 1810 - protein, 12 aa, Artificial Sequence
  Description of Artificial Sequence: Synthetic peptide
RTSQFVNSNYLA

SEQ ID NO: 1811 - protein, 7 aa, Artificial Sequence
  Description of Artificial Sequence: Synthetic peptide
GASSRAT

SEQ ID NO: 1812 - protein, 9 aa, Artificial Sequence
  Description of Artificial Sequence: Synthetic peptide
QQSSRTPWT

SEQ ID NO: 1813 - protein, 5 aa, Artificial Sequence
  Description of Artificial Sequence: Synthetic peptide
HYLMT

SEQ ID NO: 1814 - protein, 17 aa, Artificial Sequence
  Description of Artificial Sequence: Synthetic peptide
YISPSGGHTIYADSVKG

SEQ ID NO: 1815 - protein, 16 aa, Artificial Sequence
  Description of Artificial Sequence: Synthetic peptide
VGQGIRGRSRTSYFAQ

SEQ ID NO: 1816 - protein, 12 aa, Artificial Sequence
  Description of Artificial Sequence: Synthetic peptide
RTSQFVNSNYLA

SEQ ID NO: 1817 - protein, 7 aa, Artificial Sequence
  Description of Artificial Sequence: Synthetic peptide
GASSRAT

SEQ ID NO: 1818 - protein, 9 aa, Artificial Sequence
  Description of Artificial Sequence: Synthetic peptide
QQSSRTPWT

SEQ ID NO: 1819 - protein, 5 aa, Artificial Sequence
  Description of Artificial Sequence: Synthetic peptide
DYMMA

SEQ ID NO: 1820 - protein, 17 aa, Artificial Sequence
  Description of Artificial Sequence: Synthetic peptide
SIVPSGGHTHYADSVKG

SEQ ID NO: 1821 - protein, 16 aa, Artificial Sequence
  Description of Artificial Sequence: Synthetic peptide
VARGIAARSRTSYFDY

SEQ ID NO: 1822 - protein, 12 aa, Artificial Sequence
  Description of Artificial Sequence: Synthetic peptide
RTSQFVNSNYLA

SEQ ID NO: 1823 - protein, 7 aa, Artificial Sequence
  Description of Artificial Sequence: Synthetic peptide
GASSRAT

SEQ ID NO: 1824 - protein, 9 aa, Artificial Sequence
  Description of Artificial Sequence: Synthetic peptide
QQSSRTPWT

SEQ ID NO: 1825 - protein, 5 aa, Artificial Sequence
  Description of Artificial Sequence: Synthetic peptide
HYLMT

SEQ ID NO: 1826 - protein, 17 aa, Artificial Sequence
  Description of Artificial Sequence: Synthetic peptide
YISPSGGHTIYADSVKG

SEQ ID NO: 1827 - protein, 16 aa, Artificial Sequence
  Description of Artificial Sequence: Synthetic peptide
VAQGIAARSRTSSVDQ

SEQ ID NO: 1828 - protein, 12 aa, Artificial Sequence
  Description of Artificial Sequence: Synthetic peptide
RTSQFVNSNYLA

SEQ ID NO: 1829 - protein, 7 aa, Artificial Sequence
  Description of Artificial Sequence: Synthetic peptide
GASSRAT

SEQ ID NO: 1830 - protein, 9 aa, Artificial Sequence
  Description of Artificial Sequence: Synthetic peptide
QQSSRTPWT

SEQ ID NO: 1831 - protein, 5 aa, Artificial Sequence
  Description of Artificial Sequence: Synthetic peptide
HYLMT

SEQ ID NO: 1832 - protein, 17 aa, Artificial Sequence
  Description of Artificial Sequence: Synthetic peptide
YISPSGGHTIYADSVKG

SEQ ID NO: 1833 - protein, 16 aa, Artificial Sequence
  Description of Artificial Sequence: Synthetic peptide
VARGIAARSRTSFFDY

SEQ ID NO: 1834 - protein, 12 aa, Artificial Sequence
  Description of Artificial Sequence: Synthetic peptide
RTSQFVNSNYLA

SEQ ID NO: 1835 - protein, 7 aa, Artificial Sequence
  Description of Artificial Sequence: Synthetic peptide
GASSRAT

SEQ ID NO: 1836 - protein, 9 aa, Artificial Sequence
  Description of Artificial Sequence: Synthetic peptide
QQSSRTPWT

SEQ ID NO: 1837 - protein, 5 aa, Artificial Sequence
  Description of Artificial Sequence: Synthetic peptide
QYLMA

SEQ ID NO: 1838 - protein, 17 aa, Artificial Sequence
  Description of Artificial Sequence: Synthetic peptide
SIYPSGGWTKYADSVKG

SEQ ID NO: 1839 - protein, 16 aa, Artificial Sequence
  Description of Artificial Sequence: Synthetic peptide
VARGIAARSRTSYFDY

SEQ ID NO: 1840 - protein, 12 aa, Artificial Sequence
  Description of Artificial Sequence: Synthetic peptide
RTSQFVNSNYLA

SEQ ID NO: 1841 - protein, 7 aa, Artificial Sequence
  Description of Artificial Sequence: Synthetic peptide
GASSRAT

SEQ ID NO: 1842 - protein, 9 aa, Artificial Sequence
  Description of Artificial Sequence: Synthetic peptide
QQSSRTPWT

SEQ ID NO: 1843 - protein, 5 aa, Artificial Sequence
  Description of Artificial Sequence: Synthetic peptide
HYLMT

SEQ ID NO: 1844 - protein, 17 aa, Artificial Sequence
  Description of Artificial Sequence: Synthetic peptide
YISPSGGHTIYADSVKG

SEQ ID NO: 1845 - protein, 16 aa, Artificial Sequence
  Description of Artificial Sequence: Synthetic peptide
VARGIASRSRTRYCDY

SEQ ID NO: 1846 - protein, 12 aa, Artificial Sequence
  Description of Artificial Sequence: Synthetic peptide
RTSQFVNSNYLA

SEQ ID NO: 1847 - protein, 7 aa, Artificial Sequence
  Description of Artificial Sequence: Synthetic peptide
GASSRAT

SEQ ID NO: 1848 - protein, 9 aa, Artificial Sequence
  Description of Artificial Sequence: Synthetic peptide
QQSSRTPWT

SEQ ID NO: 1849 - protein, 5 aa, Artificial Sequence
  Description of Artificial Sequence: Synthetic peptide
HYLMT

SEQ ID NO: 1850 - protein, 17 aa, Artificial Sequence
  Description of Artificial Sequence: Synthetic peptide
YISPSGGHTIYADSVKG

SEQ ID NO: 1851 - protein, 16 aa, Artificial Sequence
  Description of Artificial Sequence: Synthetic peptide
VATGIVARSRTRYFDQ

SEQ ID NO: 1852 - protein, 12 aa, Artificial Sequence
  Description of Artificial Sequence: Synthetic peptide
RTSQFVNSNYLA

SEQ ID NO: 1853 - protein, 7 aa, Artificial Sequence
  Description of Artificial Sequence: Synthetic peptide
GASSRAT

SEQ ID NO: 1854 - protein, 9 aa, Artificial Sequence
  Description of Artificial Sequence: Synthetic peptide
QQSSRTPWT

SEQ ID NO: 1855 - protein, 5 aa, Artificial Sequence
  Description of Artificial Sequence: Synthetic peptide
HYLMT

SEQ ID NO: 1856 - protein, 17 aa, Artificial Sequence
  Description of Artificial Sequence: Synthetic peptide
YISPSGGHTIYADSVKG

SEQ ID NO: 1857 - protein, 16 aa, Artificial Sequence
  Description of Artificial Sequence: Synthetic peptide
VARGIAARSRTRYFDY

SEQ ID NO: 1858 - protein, 12 aa, Artificial Sequence
  Description of Artificial Sequence: Synthetic peptide
RTSQFVNSNYLA

SEQ ID NO: 1859 - protein, 7 aa, Artificial Sequence
  Description of Artificial Sequence: Synthetic peptide
GASSRAT

SEQ ID NO: 1860 - protein, 9 aa, Artificial Sequence
  Description of Artificial Sequence: Synthetic peptide
QQSSRTPWT

SEQ ID NO: 1861 - protein, 5 aa, Artificial Sequence
  Description of Artificial Sequence: Synthetic peptide
HYLMT

SEQ ID NO: 1862 - protein, 17 aa, Artificial Sequence
  Description of Artificial Sequence: Synthetic peptide
YISPSGGHTIYADSVKG

SEQ ID NO: 1863 - protein, 16 aa, Artificial Sequence
  Description of Artificial Sequence: Synthetic peptide
VAQGISARSRTSYFDY

SEQ ID NO: 1864 - protein, 12 aa, Artificial Sequence
  Description of Artificial Sequence: Synthetic peptide
RTSQFVNSNYLA

SEQ ID NO: 1865 - protein, 7 aa, Artificial Sequence
  Description of Artificial Sequence: Synthetic peptide
GASSRAT

SEQ ID NO: 1866 - protein, 9 aa, Artificial Sequence
  Description of Artificial Sequence: Synthetic peptide
QQSSRTPWT

SEQ ID NO: 1867 - protein, 5 aa, Artificial Sequence
  Description of Artificial Sequence: Synthetic peptide
HYLMT

SEQ ID NO: 1868 - protein, 17 aa, Artificial Sequence
  Description of Artificial Sequence: Synthetic peptide
YISPSGGHTIYADSVKG

SEQ ID NO: 1869 - protein, 16 aa, Artificial Sequence
  Description of Artificial Sequence: Synthetic peptide
VAQGIVARSRTSYLHQ

SEQ ID NO: 1870 - protein, 12 aa, Artificial Sequence
  Description of Artificial Sequence: Synthetic peptide
RTSQFVNSNYLA

SEQ ID NO: 1871 - protein, 7 aa, Artificial Sequence
  Description of Artificial Sequence: Synthetic peptide
GASSRAT

SEQ ID NO: 1872 - protein, 9 aa, Artificial Sequence
  Description of Artificial Sequence: Synthetic peptide
QQSSRTPWT

SEQ ID NO: 1873 - protein, 5 aa, Artificial Sequence
  Description of Artificial Sequence: Synthetic peptide
HYLMT

SEQ ID NO: 1874 - protein, 17 aa, Artificial Sequence
  Description of Artificial Sequence: Synthetic peptide
YISPSGGHTIYADSVKG

SEQ ID NO: 1875 - protein, 16 aa, Artificial Sequence
  Description of Artificial Sequence: Synthetic peptide
VGRGIAARSRTSQLDY

SEQ ID NO: 1876 - protein, 12 aa, Artificial Sequence
  Description of Artificial Sequence: Synthetic peptide
RTSQFVNSNYLA

SEQ ID NO: 1877 - protein, 7 aa, Artificial Sequence
  Description of Artificial Sequence: Synthetic peptide
GASSRAT

SEQ ID NO: 1878 - protein, 9 aa, Artificial Sequence
  Description of Artificial Sequence: Synthetic peptide
QQSSRTPWT

SEQ ID NO: 1879 - protein, 5 aa, Artificial Sequence
  Description of Artificial Sequence: Synthetic peptide
HYLMT

SEQ ID NO: 1880 - protein, 17 aa, Artificial Sequence
  Description of Artificial Sequence: Synthetic peptide
YISPSGGHTIYADSVKG

SEQ ID NO: 1881 - protein, 16 aa, Artificial Sequence
  Description of Artificial Sequence: Synthetic peptide
VARGIAARSRTSYLDY

SEQ ID NO: 1882 - protein, 12 aa, Artificial Sequence
  Description of Artificial Sequence: Synthetic peptide
RTSQFVNSNYLA

SEQ ID NO: 1883 - protein, 7 aa, Artificial Sequence
  Description of Artificial Sequence: Synthetic peptide
GASSRAT

SEQ ID NO: 1884 - protein, 9 aa, Artificial Sequence
  Description of Artificial Sequence: Synthetic peptide
QQSSRTPWT

SEQ ID NO: 1885 - protein, 5 aa, Artificial Sequence
  Description of Artificial Sequence: Synthetic peptide
NYMMG

SEQ ID NO: 1886 - protein, 17 aa, Artificial Sequence
  Description of Artificial Sequence: Synthetic peptide
SISPSGGLTKYADSVKG

SEQ ID NO: 1887 - protein, 16 aa, Artificial Sequence
  Description of Artificial Sequence: Synthetic peptide
VARGIAARSRTSYFDY

SEQ ID NO: 1888 - protein, 12 aa, Artificial Sequence
  Description of Artificial Sequence: Synthetic peptide
RTSQFVNSNYLA

SEQ ID NO: 1889 - protein, 7 aa, Artificial Sequence
  Description of Artificial Sequence: Synthetic peptide
GASSRAT

SEQ ID NO: 1890 - protein, 9 aa, Artificial Sequence
  Description of Artificial Sequence: Synthetic peptide
QQSSRTPWT

SEQ ID NO: 1891 - protein, 5 aa, Artificial Sequence
  Description of Artificial Sequence: Synthetic peptide
HYLMT

SEQ ID NO: 1892 - protein, 17 aa, Artificial Sequence
  Description of Artificial Sequence: Synthetic peptide
YISPSGGHTIYADSVKG

SEQ ID NO: 1893 - protein, 16 aa, Artificial Sequence
  Description of Artificial Sequence: Synthetic peptide
VARGIAARSRTRYFDQ

SEQ ID NO: 1894 - protein, 12 aa, Artificial Sequence
  Description of Artificial Sequence: Synthetic peptide
RTSQFVNSNYLA

SEQ ID NO: 1895 - protein, 7 aa, Artificial Sequence
  Description of Artificial Sequence: Synthetic peptide
GASSRAT

SEQ ID NO: 1896 - protein, 9 aa, Artificial Sequence
  Description of Artificial Sequence: Synthetic peptide
QQSSRTPWT

SEQ ID NO: 1897 - protein, 5 aa, Artificial Sequence
  Description of Artificial Sequence: Synthetic peptide
GYMMV

SEQ ID NO: 1898 - protein, 17 aa, Artificial Sequence
  Description of Artificial Sequence: Synthetic peptide
RISPSGGPTIYADSVKG

SEQ ID NO: 1899 - protein, 16 aa, Artificial Sequence
  Description of Artificial Sequence: Synthetic peptide
VARGIAARSRTSYFDY

SEQ ID NO: 1900 - protein, 12 aa, Artificial Sequence
  Description of Artificial Sequence: Synthetic peptide
RTSQFVNSNYLA

SEQ ID NO: 1901 - protein, 7 aa, Artificial Sequence
  Description of Artificial Sequence: Synthetic peptide
GASSRAT

SEQ ID NO: 1902 - protein, 9 aa, Artificial Sequence
  Description of Artificial Sequence: Synthetic peptide
QQSSRTPWT

SEQ ID NO: 1903 - protein, 5 aa, Artificial Sequence
  Description of Artificial Sequence: Synthetic peptide
HYLMT

SEQ ID NO: 1904 - protein, 17 aa, Artificial Sequence
  Description of Artificial Sequence: Synthetic peptide
YISPSGGHTIYADSVKG

SEQ ID NO: 1905 - protein, 16 aa, Artificial Sequence
  Description of Artificial Sequence: Synthetic peptide
VARGIAARSRTSYFDQ

SEQ ID NO: 1906 - protein, 12 aa, Artificial Sequence
  Description of Artificial Sequence: Synthetic peptide
RTSQFVNSNYLA

SEQ ID NO: 1907 - protein, 7 aa, Artificial Sequence
  Description of Artificial Sequence: Synthetic peptide
GASSRAT

SEQ ID NO: 1908 - protein, 9 aa, Artificial Sequence
  Description of Artificial Sequence: Synthetic peptide
QQSSRTPWT

SEQ ID NO: 1909 - protein, 5 aa, Artificial Sequence
  Description of Artificial Sequence: Synthetic peptide
HYLMT

SEQ ID NO: 1910 - protein, 17 aa, Artificial Sequence
  Description of Artificial Sequence: Synthetic peptide
YISPSGGHTIYADSVKG

SEQ ID NO: 1911 - protein, 16 aa, Artificial Sequence
  Description of Artificial Sequence: Synthetic peptide
VARGIAARSRTILLDQ

SEQ ID NO: 1912 - protein, 12 aa, Artificial Sequence
  Description of Artificial Sequence: Synthetic peptide
RTSQFVNSNYLA

SEQ ID NO: 1913 - protein, 7 aa, Artificial Sequence
  Description of Artificial Sequence: Synthetic peptide
GASSRAT

SEQ ID NO: 1914 - protein, 9 aa, Artificial Sequence
  Description of Artificial Sequence: Synthetic peptide
QQSSRTPWT

SEQ ID NO: 1915 - protein, 5 aa, Artificial Sequence
  Description of Artificial Sequence: Synthetic peptide
HYLMT

SEQ ID NO: 1916 - protein, 17 aa, Artificial Sequence
  Description of Artificial Sequence: Synthetic peptide
YISPSGGHTIYADSVKG

SEQ ID NO: 1917 - protein, 16 aa, Artificial Sequence
  Description of Artificial Sequence: Synthetic peptide
VARGIAARSRTSFIDY

SEQ ID NO: 1918 - protein, 12 aa, Artificial Sequence
  Description of Artificial Sequence: Synthetic peptide
RTSQFVNSNYLA

SEQ ID NO: 1919 - protein, 7 aa, Artificial Sequence
  Description of Artificial Sequence: Synthetic peptide
GASSRAT

SEQ ID NO: 1920 - protein, 9 aa, Artificial Sequence
  Description of Artificial Sequence: Synthetic peptide
QQSSRTPWT

SEQ ID NO: 1921 - protein, 5 aa, Artificial Sequence
  Description of Artificial Sequence: Synthetic peptide
TYKMQ

SEQ ID NO: 1922 - protein, 17 aa, Artificial Sequence
  Description of Artificial Sequence: Synthetic peptide
SISPSGGPTNYADSVKG

SEQ ID NO: 1923 - protein, 16 aa, Artificial Sequence
  Description of Artificial Sequence: Synthetic peptide
VARGIAARSRTSYFDY

SEQ ID NO: 1924 - protein, 12 aa, Artificial Sequence
  Description of Artificial Sequence: Synthetic peptide
RTSQFVNSNYLA

SEQ ID NO: 1925 - protein, 7 aa, Artificial Sequence
  Description of Artificial Sequence: Synthetic peptide
GASSRAT

SEQ ID NO: 1926 - protein, 9 aa, Artificial Sequence
  Description of Artificial Sequence: Synthetic peptide
QQSSRTPWT

SEQ ID NO: 1927 - protein, 5 aa, Artificial Sequence
  Description of Artificial Sequence: Synthetic peptide
HYLMT

SEQ ID NO: 1928 - protein, 17 aa, Artificial Sequence
  Description of Artificial Sequence: Synthetic peptide
YISPSGGHTIYADSVKG

SEQ ID NO: 1929 - protein, 16 aa, Artificial Sequence
  Description of Artificial Sequence: Synthetic peptide
VARGIAARSRTSYLDF

SEQ ID NO: 1930 - protein, 12 aa, Artificial Sequence
  Description of Artificial Sequence: Synthetic peptide
RTSQFVNSNYLA

SEQ ID NO: 1931 - protein, 7 aa, Artificial Sequence
  Description of Artificial Sequence: Synthetic peptide
GASSRAT

SEQ ID NO: 1932 - protein, 9 aa, Artificial Sequence
  Description of Artificial Sequence: Synthetic peptide
QQSSRTPWT

SEQ ID NO: 1933 - protein, 5 aa, Artificial Sequence
  Description of Artificial Sequence: Synthetic peptide
HYLMT

SEQ ID NO: 1934 - protein, 17 aa, Artificial Sequence
  Description of Artificial Sequence: Synthetic peptide
YISPSGGHTIYADSVKG

SEQ ID NO: 1935 - protein, 16 aa, Artificial Sequence
  Description of Artificial Sequence: Synthetic peptide
VARGIAARSRTRSFDY

SEQ ID NO: 1936 - protein, 12 aa, Artificial Sequence
  Description of Artificial Sequence: Synthetic peptide
RTSQFVNSNYLA

SEQ ID NO: 1937 - protein, 7 aa, Artificial Sequence
  Description of Artificial Sequence: Synthetic peptide
GASSRAT

SEQ ID NO: 1938 - protein, 9 aa, Artificial Sequence
  Description of Artificial Sequence: Synthetic peptide
QQSSRTPWT

SEQ ID NO: 1939 - protein, 5 aa, Artificial Sequence
  Description of Artificial Sequence: Synthetic peptide
HYLMT

SEQ ID NO: 1940 - protein, 17 aa, Artificial Sequence
  Description of Artificial Sequence: Synthetic peptide
YISPSGGHTIYADSVKG

SEQ ID NO: 1941 - protein, 16 aa, Artificial Sequence
  Description of Artificial Sequence: Synthetic peptide
VARGIAARSRTSYFNQ

SEQ ID NO: 1942 - protein, 12 aa, Artificial Sequence
  Description of Artificial Sequence: Synthetic peptide
RTSQFVNSNYLA

SEQ ID NO: 1943 - protein, 7 aa, Artificial Sequence
  Description of Artificial Sequence: Synthetic peptide
GASSRAT

SEQ ID NO: 1944 - protein, 9 aa, Artificial Sequence
  Description of Artificial Sequence: Synthetic peptide
QQSSRTPWT

SEQ ID NO: 1945 - protein, 5 aa, Artificial Sequence
  Description of Artificial Sequence: Synthetic peptide
HYLMT

SEQ ID NO: 1946 - protein, 17 aa, Artificial Sequence
  Description of Artificial Sequence: Synthetic peptide
YISPSGGHTIYADSVKG

SEQ ID NO: 1947 - protein, 16 aa, Artificial Sequence
  Description of Artificial Sequence: Synthetic peptide
VARGIAARSRTSFFDQ

SEQ ID NO: 1948 - protein, 12 aa, Artificial Sequence
  Description of Artificial Sequence: Synthetic peptide
RTSQFVNSNYLA

SEQ ID NO: 1949 - protein, 7 aa, Artificial Sequence
  Description of Artificial Sequence: Synthetic peptide
GASSRAT

SEQ ID NO: 1950 - protein, 9 aa, Artificial Sequence
  Description of Artificial Sequence: Synthetic peptide
QQSSRTPWT

SEQ ID NO: 1951 - protein, 5 aa, Artificial Sequence
  Description of Artificial Sequence: Synthetic peptide
HYLMT

SEQ ID NO: 1952 - protein, 17 aa, Artificial Sequence
  Description of Artificial Sequence: Synthetic peptide
YISPSGGHTIYADSVKG

SEQ ID NO: 1953 - protein, 16 aa, Artificial Sequence
  Description of Artificial Sequence: Synthetic peptide
VARGIAARSRTSYFDT

SEQ ID NO: 1954 - protein, 12 aa, Artificial Sequence
  Description of Artificial Sequence: Synthetic peptide
RTSQFVNSNYLA

SEQ ID NO: 1955 - protein, 7 aa, Artificial Sequence
  Description of Artificial Sequence: Synthetic peptide
GASSRAT

SEQ ID NO: 1956 - protein, 9 aa, Artificial Sequence
  Description of Artificial Sequence: Synthetic peptide
QQSSRTPWT

SEQ ID NO: 1957 - protein, 5 aa, Artificial Sequence
  Description of Artificial Sequence: Synthetic peptide
DYMMT

SEQ ID NO: 1958 - protein, 17 aa, Artificial Sequence
  Description of Artificial Sequence: Synthetic peptide
YISPSGGLTSYADSVKG

SEQ ID NO: 1959 - protein, 16 aa, Artificial Sequence
  Description of Artificial Sequence: Synthetic peptide
VARGIAARSRTSYFDY

SEQ ID NO: 1960 - protein, 12 aa, Artificial Sequence
  Description of Artificial Sequence: Synthetic peptide
RTSQFVNSNYLA

SEQ ID NO: 1961 - protein, 7 aa, Artificial Sequence
  Description of Artificial Sequence: Synthetic peptide
GASSRAT

SEQ ID NO: 1962 - protein, 9 aa, Artificial Sequence
  Description of Artificial Sequence: Synthetic peptide
QQSSRTPWT

SEQ ID NO: 1963 - protein, 5 aa, Artificial Sequence
  Description of Artificial Sequence: Synthetic peptide
EYMMV

SEQ ID NO: 1964 - protein, 17 aa, Artificial Sequence
  Description of Artificial Sequence: Synthetic peptide
RISPSGGTTEYADSVKG

SEQ ID NO: 1965 - protein, 16 aa, Artificial Sequence
  Description of Artificial Sequence: Synthetic peptide
VARGIAARSRTSYFDY

SEQ ID NO: 1966 - protein, 12 aa, Artificial Sequence
  Description of Artificial Sequence: Synthetic peptide
RTSQFVNSNYLA

SEQ ID NO: 1967 - protein, 7 aa, Artificial Sequence
  Description of Artificial Sequence: Synthetic peptide
GASSRAT

SEQ ID NO: 1968 - protein, 9 aa, Artificial Sequence
  Description of Artificial Sequence: Synthetic peptide
QQSSRTPWT

SEQ ID NO: 1969 - protein, 5 aa, Artificial Sequence
  Description of Artificial Sequence: Synthetic peptide
HYLMT

SEQ ID NO: 1970 - protein, 17 aa, Artificial Sequence
  Description of Artificial Sequence: Synthetic peptide
YISPSGGHTIYADSVKG

SEQ ID NO: 1971 - protein, 16 aa, Artificial Sequence
  Description of Artificial Sequence: Synthetic peptide
VARGIAARSRTRYIDQ

SEQ ID NO: 1972 - protein, 12 aa, Artificial Sequence
  Description of Artificial Sequence: Synthetic peptide
RTSQFVNSNYLA

SEQ ID NO: 1973 - protein, 7 aa, Artificial Sequence
  Description of Artificial Sequence: Synthetic peptide
GASSRAT

SEQ ID NO: 1974 - protein, 9 aa, Artificial Sequence
  Description of Artificial Sequence: Synthetic peptide
QQSSRTPWT

SEQ ID NO: 1975 - protein, 5 aa, Artificial Sequence
  Description of Artificial Sequence: Synthetic peptide
VYMMS

SEQ ID NO: 1976 - protein, 17 aa, Artificial Sequence
  Description of Artificial Sequence: Synthetic peptide
SIVPSGGSTTYADSVKG

SEQ ID NO: 1977 - protein, 16 aa, Artificial Sequence
  Description of Artificial Sequence: Synthetic peptide
VARGIAARSRTSYFDY

SEQ ID NO: 1978 - protein, 12 aa, Artificial Sequence
  Description of Artificial Sequence: Synthetic peptide
RTSQFVNSNYLA

SEQ ID NO: 1979 - protein, 7 aa, Artificial Sequence
  Description of Artificial Sequence: Synthetic peptide
GASSRAT

SEQ ID NO: 1980 - protein, 9 aa, Artificial Sequence
  Description of Artificial Sequence: Synthetic peptide
QQSSRTPWT

SEQ ID NO: 1981 - protein, 5 aa, Artificial Sequence
  Description of Artificial Sequence: Synthetic peptide
HYLMT

SEQ ID NO: 1982 - protein, 17 aa, Artificial Sequence
  Description of Artificial Sequence: Synthetic peptide
YISPSGGHTIYADSVKG

SEQ ID NO: 1983 - protein, 16 aa, Artificial Sequence
  Description of Artificial Sequence: Synthetic peptide
VARGIAYRRRTSYFDY

SEQ ID NO: 1984 - protein, 12 aa, Artificial Sequence
  Description of Artificial Sequence: Synthetic peptide
RTSQFVNSNYLA

SEQ ID NO: 1985 - protein, 7 aa, Artificial Sequence
  Description of Artificial Sequence: Synthetic peptide
GASSRAT

SEQ ID NO: 1986 - protein, 9 aa, Artificial Sequence
  Description of Artificial Sequence: Synthetic peptide
QQSSRTPWT

SEQ ID NO: 1987 - protein, 5 aa, Artificial Sequence
  Description of Artificial Sequence: Synthetic peptide
HYLMT

SEQ ID NO: 1988 - protein, 17 aa, Artificial Sequence
  Description of Artificial Sequence: Synthetic peptide
YISPSGGHTIYADSVKG

SEQ ID NO: 1989 - protein, 16 aa, Artificial Sequence
  Description of Artificial Sequence: Synthetic peptide
VARGIADRSRTSYSDY

SEQ ID NO: 1990 - protein, 12 aa, Artificial Sequence
  Description of Artificial Sequence: Synthetic peptide
RTSQFVNSNYLA

SEQ ID NO: 1991 - protein, 7 aa, Artificial Sequence
  Description of Artificial Sequence: Synthetic peptide
GASSRAT

SEQ ID NO: 1992 - protein, 9 aa, Artificial Sequence
  Description of Artificial Sequence: Synthetic peptide
QQSSRTPWT

SEQ ID NO: 1993 - protein, 5 aa, Artificial Sequence
  Description of Artificial Sequence: Synthetic peptide
QYMMM

SEQ ID NO: 1994 - protein, 17 aa, Artificial Sequence
  Description of Artificial Sequence: Synthetic peptide
RISPSGGSTLYADSVKG

SEQ ID NO: 1995 - protein, 16 aa, Artificial Sequence
  Description of Artificial Sequence: Synthetic peptide
VARGIAARSRTSYFDY

SEQ ID NO: 1996 - protein, 12 aa, Artificial Sequence
  Description of Artificial Sequence: Synthetic peptide
RTSQFVNSNYLA

SEQ ID NO: 1997 - protein, 7 aa, Artificial Sequence
  Description of Artificial Sequence: Synthetic peptide
GASSRAT

SEQ ID NO: 1998 - protein, 9 aa, Artificial Sequence
  Description of Artificial Sequence: Synthetic peptide
QQSSRTPWT

SEQ ID NO: 1999 - protein, 5 aa, Artificial Sequence
  Description of Artificial Sequence: Synthetic peptide
DYMMM

SEQ ID NO: 2000 - protein, 17 aa, Artificial Sequence
  Description of Artificial Sequence: Synthetic peptide
SIVPSGGHTQYADSVKG

SEQ ID NO: 2001 - protein, 16 aa, Artificial Sequence
  Description of Artificial Sequence: Synthetic peptide
VARGIAARSRTSYFDY

SEQ ID NO: 2002 - protein, 12 aa, Artificial Sequence
  Description of Artificial Sequence: Synthetic peptide
RTSQFVNSNYLA

SEQ ID NO: 2003 - protein, 7 aa, Artificial Sequence
  Description of Artificial Sequence: Synthetic peptide
GASSRAT

SEQ ID NO: 2004 - protein, 9 aa, Artificial Sequence
  Description of Artificial Sequence: Synthetic peptide
QQSSRTPWT

SEQ ID NO: 2005 - protein, 5 aa, Artificial Sequence
  Description of Artificial Sequence: Synthetic peptide
HYLMT

SEQ ID NO: 2006 - protein, 17 aa, Artificial Sequence
  Description of Artificial Sequence: Synthetic peptide
YISPSGGHTIYADSVKG

SEQ ID NO: 2007 - protein, 16 aa, Artificial Sequence
  Description of Artificial Sequence: Synthetic peptide
VARGIAARSRNSQQDY

SEQ ID NO: 2008 - protein, 12 aa, Artificial Sequence
  Description of Artificial Sequence: Synthetic peptide
RTSQFVNSNYLA

SEQ ID NO: 2009 - protein, 7 aa, Artificial Sequence
  Description of Artificial Sequence: Synthetic peptide
GASSRAT

SEQ ID NO: 2010 - protein, 9 aa, Artificial Sequence
  Description of Artificial Sequence: Synthetic peptide
QQSSRTPWT

SEQ ID NO: 2011 - protein, 5 aa, Artificial Sequence
  Description of Artificial Sequence: Synthetic peptide
HYLMT

SEQ ID NO: 2012 - protein, 17 aa, Artificial Sequence
  Description of Artificial Sequence: Synthetic peptide
YISPSGGHTIYADSVKG

SEQ ID NO: 2013 - protein, 16 aa, Artificial Sequence
  Description of Artificial Sequence: Synthetic peptide
VARGIAARSRTSYFDQ

SEQ ID NO: 2014 - protein, 12 aa, Artificial Sequence
  Description of Artificial Sequence: Synthetic peptide
RTSQFVNSNYLA

SEQ ID NO: 2015 - protein, 7 aa, Artificial Sequence
  Description of Artificial Sequence: Synthetic peptide
GASSRAT

SEQ ID NO: 2016 - protein, 9 aa, Artificial Sequence
  Description of Artificial Sequence: Synthetic peptide
QQSSRTPWT

SEQ ID NO: 2017 - protein, 5 aa, Artificial Sequence
  Description of Artificial Sequence: Synthetic peptide
HYLMT

SEQ ID NO: 2018 - protein, 17 aa, Artificial Sequence
  Description of Artificial Sequence: Synthetic peptide
YISPSGGHTIYADSVKG

SEQ ID NO: 2019 - protein, 16 aa, Artificial Sequence
  Description of Artificial Sequence: Synthetic peptide
VARGIAARSRTVYFDH

SEQ ID NO: 2020 - protein, 12 aa, Artificial Sequence
  Description of Artificial Sequence: Synthetic peptide
RTSQFVNSNYLA

SEQ ID NO: 2021 - protein, 7 aa, Artificial Sequence
  Description of Artificial Sequence: Synthetic peptide
GASSRAT

SEQ ID NO: 2022 - protein, 9 aa, Artificial Sequence
  Description of Artificial Sequence: Synthetic peptide
QQSSRTPWT

SEQ ID NO: 2023 - protein, 5 aa, Artificial Sequence
  Description of Artificial Sequence: Synthetic peptide
TYMMQ

SEQ ID NO: 2024 - protein, 17 aa, Artificial Sequence
  Description of Artificial Sequence: Synthetic peptide
YIGPSGGKTDYADSVKG

SEQ ID NO: 2025 - protein, 16 aa, Artificial Sequence
  Description of Artificial Sequence: Synthetic peptide
VARGIAARSRTSYFDY

SEQ ID NO: 2026 - protein, 12 aa, Artificial Sequence
  Description of Artificial Sequence: Synthetic peptide
RTSQFVNSNYLA

SEQ ID NO: 2027 - protein, 7 aa, Artificial Sequence
  Description of Artificial Sequence: Synthetic peptide
GASSRAT

SEQ ID NO: 2028 - protein, 9 aa, Artificial Sequence
  Description of Artificial Sequence: Synthetic peptide
QQSSRTPWT

SEQ ID NO: 2029 - protein, 5 aa, Artificial Sequence
  Description of Artificial Sequence: Synthetic peptide
HYLMT

SEQ ID NO: 2030 - protein, 17 aa, Artificial Sequence
  Description of Artificial Sequence: Synthetic peptide
YISPSGGHTIYADSVKG

SEQ ID NO: 2031 - protein, 16 aa, Artificial Sequence
  Description of Artificial Sequence: Synthetic peptide
VAQGIAARSRTTQFDY

SEQ ID NO: 2032 - protein, 12 aa, Artificial Sequence
  Description of Artificial Sequence: Synthetic peptide
RTSQFVNSNYLA

SEQ ID NO: 2033 - protein, 7 aa, Artificial Sequence
  Description of Artificial Sequence: Synthetic peptide
GASSRAT

SEQ ID NO: 2034 - protein, 9 aa, Artificial Sequence
  Description of Artificial Sequence: Synthetic peptide
QQSSRTPWT

SEQ ID NO: 2035 - protein, 5 aa, Artificial Sequence
  Description of Artificial Sequence: Synthetic peptide
GYKMQ

SEQ ID NO: 2036 - protein, 17 aa, Artificial Sequence
  Description of Artificial Sequence: Synthetic peptide
SISPSGGITMYADSVKG

SEQ ID NO: 2037 - protein, 16 aa, Artificial Sequence
  Description of Artificial Sequence: Synthetic peptide
VARGIAARSRTSYFDY

SEQ ID NO: 2038 - protein, 12 aa, Artificial Sequence
  Description of Artificial Sequence: Synthetic peptide
RTSQFVNSNYLA

SEQ ID NO: 2039 - protein, 7 aa, Artificial Sequence
  Description of Artificial Sequence: Synthetic peptide
GASSRAT

SEQ ID NO: 2040 - protein, 9 aa, Artificial Sequence
  Description of Artificial Sequence: Synthetic peptide
QQSSRTPWT

SEQ ID NO: 2041 - protein, 5 aa, Artificial Sequence
  Description of Artificial Sequence: Synthetic peptide
HYLMT

SEQ ID NO: 2042 - protein, 17 aa, Artificial Sequence
  Description of Artificial Sequence: Synthetic peptide
YISPSGGHTIYADSVKG

SEQ ID NO: 2043 - protein, 16 aa, Artificial Sequence
  Description of Artificial Sequence: Synthetic peptide
VGRGIAARSRTSFFDQ

SEQ ID NO: 2044 - protein, 12 aa, Artificial Sequence
  Description of Artificial Sequence: Synthetic peptide
RTSQFVNSNYLA

SEQ ID NO: 2045 - protein, 7 aa, Artificial Sequence
  Description of Artificial Sequence: Synthetic peptide
GASSRAT

SEQ ID NO: 2046 - protein, 9 aa, Artificial Sequence
  Description of Artificial Sequence: Synthetic peptide
QQSSRTPWT

SEQ ID NO: 2047 - protein, 5 aa, Artificial Sequence
  Description of Artificial Sequence: Synthetic peptide
TYLMA

SEQ ID NO: 2048 - protein, 17 aa, Artificial Sequence
  Description of Artificial Sequence: Synthetic peptide
GIVSSGGRTLYADSVKG

SEQ ID NO: 2049 - protein, 16 aa, Artificial Sequence
  Description of Artificial Sequence: Synthetic peptide
VARGIAARSRTSYFDY

SEQ ID NO: 2050 - protein, 12 aa, Artificial Sequence
  Description of Artificial Sequence: Synthetic peptide
RTSQFVNSNYLA

SEQ ID NO: 2051 - protein, 7 aa, Artificial Sequence
  Description of Artificial Sequence: Synthetic peptide
GASSRAT

SEQ ID NO: 2052 - protein, 9 aa, Artificial Sequence
  Description of Artificial Sequence: Synthetic peptide
QQSSRTPWT

SEQ ID NO: 2053 - protein, 5 aa, Artificial Sequence
  Description of Artificial Sequence: Synthetic peptide
HYLMT

SEQ ID NO: 2054 - protein, 17 aa, Artificial Sequence
  Description of Artificial Sequence: Synthetic peptide
YISPSGGHTIYADSVKG

SEQ ID NO: 2055 - protein, 16 aa, Artificial Sequence
  Description of Artificial Sequence: Synthetic peptide
VARGIAARSRTSQFDH

SEQ ID NO: 2056 - protein, 12 aa, Artificial Sequence
  Description of Artificial Sequence: Synthetic peptide
RTSQFVNSNYLA

SEQ ID NO: 2057 - protein, 7 aa, Artificial Sequence
  Description of Artificial Sequence: Synthetic peptide
GASSRAT

SEQ ID NO: 2058 - protein, 9 aa, Artificial Sequence
  Description of Artificial Sequence: Synthetic peptide
QQSSRTPWT

SEQ ID NO: 2059 - protein, 5 aa, Artificial Sequence
  Description of Artificial Sequence: Synthetic peptide
NYTMG

SEQ ID NO: 2060 - protein, 17 aa, Artificial Sequence
  Description of Artificial Sequence: Synthetic peptide
SISPSGGKTDYADSVKG

SEQ ID NO: 2061 - protein, 16 aa, Artificial Sequence
  Description of Artificial Sequence: Synthetic peptide
VARGIAARSRTSYFDY

SEQ ID NO: 2062 - protein, 12 aa, Artificial Sequence
  Description of Artificial Sequence: Synthetic peptide
RTSQFVNSNYLA

SEQ ID NO: 2063 - protein, 7 aa, Artificial Sequence
  Description of Artificial Sequence: Synthetic peptide
GASSRAT

SEQ ID NO: 2064 - protein, 9 aa, Artificial Sequence
  Description of Artificial Sequence: Synthetic peptide
QQSSRTPWT

SEQ ID NO: 2065 - protein, 5 aa, Artificial Sequence
  Description of Artificial Sequence: Synthetic peptide
EYMMM

SEQ ID NO: 2066 - protein, 17 aa, Artificial Sequence
  Description of Artificial Sequence: Synthetic peptide
VISPSGGQTHYADSVKG

SEQ ID NO: 2067 - protein, 16 aa, Artificial Sequence
  Description of Artificial Sequence: Synthetic peptide
VARGIAARSRTSYFDY

SEQ ID NO: 2068 - protein, 12 aa, Artificial Sequence
  Description of Artificial Sequence: Synthetic peptide
RTSQFVNSNYLA

SEQ ID NO: 2069 - protein, 7 aa, Artificial Sequence
  Description of Artificial Sequence: Synthetic peptide
GASSRAT

SEQ ID NO: 2070 - protein, 9 aa, Artificial Sequence
  Description of Artificial Sequence: Synthetic peptide
QQSSRTPWT

SEQ ID NO: 2071 - protein, 5 aa, Artificial Sequence
  Description of Artificial Sequence: Synthetic peptide
NYTMQ

SEQ ID NO: 2072 - protein, 17 aa, Artificial Sequence
  Description of Artificial Sequence: Synthetic peptide
YISPSGGYTGYADSVKG

SEQ ID NO: 2073 - protein, 16 aa, Artificial Sequence
  Description of Artificial Sequence: Synthetic peptide
VARGIAARSRTSYFDY

SEQ ID NO: 2074 - protein, 12 aa, Artificial Sequence
  Description of Artificial Sequence: Synthetic peptide
RTSQFVNSNYLA

SEQ ID NO: 2075 - protein, 7 aa, Artificial Sequence
  Description of Artificial Sequence: Synthetic peptide
GASSRAT

SEQ ID NO: 2076 - protein, 9 aa, Artificial Sequence
  Description of Artificial Sequence: Synthetic peptide
QQSSRTPWT

SEQ ID NO: 2077 - protein, 5 aa, Artificial Sequence
  Description of Artificial Sequence: Synthetic peptide
HYLMT

SEQ ID NO: 2078 - protein, 17 aa, Artificial Sequence
  Description of Artificial Sequence: Synthetic peptide
YISPSGGHTIYADSVKG

SEQ ID NO: 2079 - protein, 16 aa, Artificial Sequence
  Description of Artificial Sequence: Synthetic peptide
VARGIAARSRTINLDY

SEQ ID NO: 2080 - protein, 12 aa, Artificial Sequence
  Description of Artificial Sequence: Synthetic peptide
RTSQFVNSNYLA

SEQ ID NO: 2081 - protein, 7 aa, Artificial Sequence
  Description of Artificial Sequence: Synthetic peptide
GASSRAT

SEQ ID NO: 2082 - protein, 9 aa, Artificial Sequence
  Description of Artificial Sequence: Synthetic peptide
QQSSRTPWT

SEQ ID NO: 2083 - protein, 5 aa, Artificial Sequence
  Description of Artificial Sequence: Synthetic peptide
HYLMT

SEQ ID NO: 2084 - protein, 17 aa, Artificial Sequence
  Description of Artificial Sequence: Synthetic peptide
YISPSGGHTIYADSVKG

SEQ ID NO: 2085 - protein, 16 aa, Artificial Sequence
  Description of Artificial Sequence: Synthetic peptide
VARGIAARQRTSYYDY

SEQ ID NO: 2086 - protein, 12 aa, Artificial Sequence
  Description of Artificial Sequence: Synthetic peptide
RTSQFVNSNYLA

SEQ ID NO: 2087 - protein, 7 aa, Artificial Sequence
  Description of Artificial Sequence: Synthetic peptide
GASSRAT

SEQ ID NO: 2088 - protein, 9 aa, Artificial Sequence
  Description of Artificial Sequence: Synthetic peptide
QQSSRTPWT

SEQ ID NO: 2089 - protein, 5 aa, Artificial Sequence
  Description of Artificial Sequence: Synthetic peptide
HYLMT

SEQ ID NO: 2090 - protein, 17 aa, Artificial Sequence
  Description of Artificial Sequence: Synthetic peptide
YISPSGGHTIYADSVKG

SEQ ID NO: 2091 - protein, 16 aa, Artificial Sequence
  Description of Artificial Sequence: Synthetic peptide
VAQGISGRSRLSYVDY

SEQ ID NO: 2092 - protein, 12 aa, Artificial Sequence
  Description of Artificial Sequence: Synthetic peptide
RTSQFVNSNYLA

SEQ ID NO: 2093 - protein, 7 aa, Artificial Sequence
  Description of Artificial Sequence: Synthetic peptide
GASSRAT

SEQ ID NO: 2094 - protein, 9 aa, Artificial Sequence
  Description of Artificial Sequence: Synthetic peptide
QQSSRTPWT

SEQ ID NO: 2095 - protein, 5 aa, Artificial Sequence
  Description of Artificial Sequence: Synthetic peptide
HYLMT

SEQ ID NO: 2096 - protein, 17 aa, Artificial Sequence
  Description of Artificial Sequence: Synthetic peptide
YISPSGGHTIYADSVKG

SEQ ID NO: 2097 - protein, 16 aa, Artificial Sequence
  Description of Artificial Sequence: Synthetic peptide
VARGIAARSRTSQFDY

SEQ ID NO: 2098 - protein, 12 aa, Artificial Sequence
  Description of Artificial Sequence: Synthetic peptide
RTSQFVNSNYLA

SEQ ID NO: 2099 - protein, 7 aa, Artificial Sequence
  Description of Artificial Sequence: Synthetic peptide
GASSRAT

SEQ ID NO: 2100 - protein, 9 aa, Artificial Sequence
  Description of Artificial Sequence: Synthetic peptide
QQSSRTPWT

SEQ ID NO: 2101 - protein, 5 aa, Artificial Sequence
  Description of Artificial Sequence: Synthetic peptide
HYLMT

SEQ ID NO: 2102 - protein, 17 aa, Artificial Sequence
  Description of Artificial Sequence: Synthetic peptide
YISPSGGHTIYADSVKG

SEQ ID NO: 2103 - protein, 16 aa, Artificial Sequence
  Description of Artificial Sequence: Synthetic peptide
VARGITARSRTSYFDD

SEQ ID NO: 2104 - protein, 12 aa, Artificial Sequence
  Description of Artificial Sequence: Synthetic peptide
RTSQFVNSNYLA

SEQ ID NO: 2105 - protein, 7 aa, Artificial Sequence
  Description of Artificial Sequence: Synthetic peptide
GASSRAT

SEQ ID NO: 2106 - protein, 9 aa, Artificial Sequence
  Description of Artificial Sequence: Synthetic peptide
QQSSRTPWT

SEQ ID NO: 2107 - protein, 5 aa, Artificial Sequence
  Description of Artificial Sequence: Synthetic peptide
NYDMI

SEQ ID NO: 2108 - protein, 17 aa, Artificial Sequence
  Description of Artificial Sequence: Synthetic peptide
SISSSGGTTKYADSVKG

SEQ ID NO: 2109 - protein, 16 aa, Artificial Sequence
  Description of Artificial Sequence: Synthetic peptide
VARGIAARSRTSYFDY

SEQ ID NO: 2110 - protein, 12 aa, Artificial Sequence
  Description of Artificial Sequence: Synthetic peptide
RTSQFVNSNYLA

SEQ ID NO: 2111 - protein, 7 aa, Artificial Sequence
  Description of Artificial Sequence: Synthetic peptide
GASSRAT

SEQ ID NO: 2112 - protein, 9 aa, Artificial Sequence
  Description of Artificial Sequence: Synthetic peptide
QQSSRTPWT

SEQ ID NO: 2113 - protein, 5 aa, Artificial Sequence
  Description of Artificial Sequence: Synthetic peptide
VYMMI

SEQ ID NO: 2114 - protein, 17 aa, Artificial Sequence
  Description of Artificial Sequence: Synthetic peptide
SISPSGGQTTYADSVKG

SEQ ID NO: 2115 - protein, 16 aa, Artificial Sequence
  Description of Artificial Sequence: Synthetic peptide
VARGIAARSRTSYFDY

SEQ ID NO: 2116 - protein, 12 aa, Artificial Sequence
  Description of Artificial Sequence: Synthetic peptide
RTSQFVNSNYLA

SEQ ID NO: 2117 - protein, 7 aa, Artificial Sequence
  Description of Artificial Sequence: Synthetic peptide
GASSRAT

SEQ ID NO: 2118 - protein, 9 aa, Artificial Sequence
  Description of Artificial Sequence: Synthetic peptide
QQSSRTPWT

SEQ ID NO: 2119 - protein, 5 aa, Artificial Sequence
  Description of Artificial Sequence: Synthetic peptide
HYLMT

SEQ ID NO: 2120 - protein, 17 aa, Artificial Sequence
  Description of Artificial Sequence: Synthetic peptide
YISPSGGHTIYADSVKG

SEQ ID NO: 2121 - protein, 16 aa, Artificial Sequence
  Description of Artificial Sequence: Synthetic peptide
QARGIAARSRTSYFDY

SEQ ID NO: 2122 - protein, 12 aa, Artificial Sequence
  Description of Artificial Sequence: Synthetic peptide
RTSQFVNSNYLA

SEQ ID NO: 2123 - protein, 7 aa, Artificial Sequence
  Description of Artificial Sequence: Synthetic peptide
GASSRAT

SEQ ID NO: 2124 - protein, 9 aa, Artificial Sequence
  Description of Artificial Sequence: Synthetic peptide
QQSSRTPWT

SEQ ID NO: 2125 - protein, 5 aa, Artificial Sequence
  Description of Artificial Sequence: Synthetic peptide
HYLMT

SEQ ID NO: 2126 - protein, 17 aa, Artificial Sequence
  Description of Artificial Sequence: Synthetic peptide
YISPSGGHTIYADSVKG

SEQ ID NO: 2127 - protein, 16 aa, Artificial Sequence
  Description of Artificial Sequence: Synthetic peptide
VARGISARSRTSCFDY

SEQ ID NO: 2128 - protein, 12 aa, Artificial Sequence
  Description of Artificial Sequence: Synthetic peptide
RTSQFVNSNYLA

SEQ ID NO: 2129 - protein, 7 aa, Artificial Sequence
  Description of Artificial Sequence: Synthetic peptide
GASSRAT

SEQ ID NO: 2130 - protein, 9 aa, Artificial Sequence
  Description of Artificial Sequence: Synthetic peptide
QQSSRTPWT

SEQ ID NO: 2131 - protein, 5 aa, Artificial Sequence
  Description of Artificial Sequence: Synthetic peptide
QYMMV

SEQ ID NO: 2132 - protein, 17 aa, Artificial Sequence
  Description of Artificial Sequence: Synthetic peptide
SIYSSGGNTPYADSVKG

SEQ ID NO: 2133 - protein, 16 aa, Artificial Sequence
  Description of Artificial Sequence: Synthetic peptide
VARGIAARSRTSYFDY

SEQ ID NO: 2134 - protein, 12 aa, Artificial Sequence
  Description of Artificial Sequence: Synthetic peptide
RTSQFVNSNYLA

SEQ ID NO: 2135 - protein, 7 aa, Artificial Sequence
  Description of Artificial Sequence: Synthetic peptide
GASSRAT

SEQ ID NO: 2136 - protein, 9 aa, Artificial Sequence
  Description of Artificial Sequence: Synthetic peptide
QQSSRTPWT

SEQ ID NO: 2137 - protein, 5 aa, Artificial Sequence
  Description of Artificial Sequence: Synthetic peptide
HYLMT

SEQ ID NO: 2138 - protein, 17 aa, Artificial Sequence
  Description of Artificial Sequence: Synthetic peptide
YISPSGGHTIYADSVKG

SEQ ID NO: 2139 - protein, 16 aa, Artificial Sequence
  Description of Artificial Sequence: Synthetic peptide
VGRGIAARSRTSYFDK

SEQ ID NO: 2140 - protein, 12 aa, Artificial Sequence
  Description of Artificial Sequence: Synthetic peptide
RTSQFVNSNYLA

SEQ ID NO: 2141 - protein, 7 aa, Artificial Sequence
  Description of Artificial Sequence: Synthetic peptide
GASSRAT

SEQ ID NO: 2142 - protein, 9 aa, Artificial Sequence
  Description of Artificial Sequence: Synthetic peptide
QQSSRTPWT

SEQ ID NO: 2143 - protein, 5 aa, Artificial Sequence
  Description of Artificial Sequence: Synthetic peptide
QYDMI

SEQ ID NO: 2144 - protein, 17 aa, Artificial Sequence
  Description of Artificial Sequence: Synthetic peptide
YISSSGGFTRYADSVKG

SEQ ID NO: 2145 - protein, 16 aa, Artificial Sequence
  Description of Artificial Sequence: Synthetic peptide
VARGIAARSRTSYFDY

SEQ ID NO: 2146 - protein, 12 aa, Artificial Sequence
  Description of Artificial Sequence: Synthetic peptide
RTSQFVNSNYLA

SEQ ID NO: 2147 - protein, 7 aa, Artificial Sequence
  Description of Artificial Sequence: Synthetic peptide
GASSRAT

SEQ ID NO: 2148 - protein, 9 aa, Artificial Sequence
  Description of Artificial Sequence: Synthetic peptide
QQSSRTPWT

SEQ ID NO: 2149 - protein, 5 aa, Artificial Sequence
  Description of Artificial Sequence: Synthetic peptide
SQQMV

SEQ ID NO: 2150 - protein, 17 aa, Artificial Sequence
  Description of Artificial Sequence: Synthetic peptide
YISPSGGNTYYADSVKG

SEQ ID NO: 2151 - protein, 16 aa, Artificial Sequence
  Description of Artificial Sequence: Synthetic peptide
VARGIAARSRTSYFDY

SEQ ID NO: 2152 - protein, 12 aa, Artificial Sequence
  Description of Artificial Sequence: Synthetic peptide
RTSQFVNSNYLA

SEQ ID NO: 2153 - protein, 7 aa, Artificial Sequence
  Description of Artificial Sequence: Synthetic peptide
GASSRAT

SEQ ID NO: 2154 - protein, 9 aa, Artificial Sequence
  Description of Artificial Sequence: Synthetic peptide
QQSSRTPWT

SEQ ID NO: 2155 - protein, 5 aa, Artificial Sequence
  Description of Artificial Sequence: Synthetic peptide
NYLMA

SEQ ID NO: 2156 - protein, 17 aa, Artificial Sequence
  Description of Artificial Sequence: Synthetic peptide
WIVPSGGYTEYADSVKG

SEQ ID NO: 2157 - protein, 16 aa, Artificial Sequence
  Description of Artificial Sequence: Synthetic peptide
VARGIAARSRTSYFDY

SEQ ID NO: 2158 - protein, 12 aa, Artificial Sequence
  Description of Artificial Sequence: Synthetic peptide
RTSQFVNSNYLA

SEQ ID NO: 2159 - protein, 7 aa, Artificial Sequence
  Description of Artificial Sequence: Synthetic peptide
GASSRAT

SEQ ID NO: 2160 - protein, 9 aa, Artificial Sequence
  Description of Artificial Sequence: Synthetic peptide
QQSSRTPWT

SEQ ID NO: 2161 - protein, 5 aa, Artificial Sequence
  Description of Artificial Sequence: Synthetic peptide
HYLMT

SEQ ID NO: 2162 - protein, 17 aa, Artificial Sequence
  Description of Artificial Sequence: Synthetic peptide
YISPSGGHTIYADSVKG

SEQ ID NO: 2163 - protein, 16 aa, Artificial Sequence
  Description of Artificial Sequence: Synthetic peptide
VARGIVARSRTSNFDQ

SEQ ID NO: 2164 - protein, 12 aa, Artificial Sequence
  Description of Artificial Sequence: Synthetic peptide
RTSQFVNSNYLA

SEQ ID NO: 2165 - protein, 7 aa, Artificial Sequence
  Description of Artificial Sequence: Synthetic peptide
GASSRAT

SEQ ID NO: 2166 - protein, 9 aa, Artificial Sequence
  Description of Artificial Sequence: Synthetic peptide
QQSSRTPWT

SEQ ID NO: 2167 - protein, 5 aa, Artificial Sequence
  Description of Artificial Sequence: Synthetic peptide
HYLMT

SEQ ID NO: 2168 - protein, 17 aa, Artificial Sequence
  Description of Artificial Sequence: Synthetic peptide
YISPSGGHTIYADSVKG

SEQ ID NO: 2169 - protein, 16 aa, Artificial Sequence
  Description of Artificial Sequence: Synthetic peptide
LARGIAARSRTSYQDI

SEQ ID NO: 2170 - protein, 12 aa, Artificial Sequence
  Description of Artificial Sequence: Synthetic peptide
RTSQFVNSNYLA

SEQ ID NO: 2171 - protein, 7 aa, Artificial Sequence
  Description of Artificial Sequence: Synthetic peptide
GASSRAT

SEQ ID NO: 2172 - protein, 9 aa, Artificial Sequence
  Description of Artificial Sequence: Synthetic peptide
QQSSRTPWT

SEQ ID NO: 2173 - protein, 5 aa, Artificial Sequence
  Description of Artificial Sequence: Synthetic peptide
SYMMV

SEQ ID NO: 2174 - protein, 17 aa, Artificial Sequence
  Description of Artificial Sequence: Synthetic peptide
SISPSGGYTIQADSVKG

SEQ ID NO: 2175 - protein, 16 aa, Artificial Sequence
  Description of Artificial Sequence: Synthetic peptide
VARGIAARSRTSYFDY

SEQ ID NO: 2176 - protein, 109 aa, Artificial Sequence; identical to SEQ ID NO: 1142
  Description of Artificial Sequence: Synthetic polypeptide

SEQ ID NO: 2177 - protein, 142 aa, Artificial Sequence
  Description of Artificial Sequence: Synthetic polypeptide
EVQLLESGGGLVQPGGSLRLSCAASGFTFSNYLMAWVRQAPGKGLEWVSWIVPSGGYTEYADSVKGRFTISRDNSKNTLYLQMNSLRAEDTAVYYCARVARGIAARSRTSYFDYWGQGTLVTVSSASTKGPSVFPLAPSSKS

SEQ ID NO: 2178 - protein, 109 aa, Artificial Sequence; identical to SEQ ID NO: 1142
  Description of Artificial Sequence: Synthetic polypeptide

SEQ ID NO: 2179 - protein, 142 aa, Artificial Sequence
  Description of Artificial Sequence: Synthetic polypeptide
EVQLLESGGGLVQPGGSLRLSCAASGFTFSVYMMIWVRQAPGKGLEWVSSISPSGGQTTYADSVKGRFTISRDNSKNTLYLQMNSLRAEDTAVYYCARVARGIAARSRTSYFDYWGQGTLVTVSSASTKGPSVFPLAPSSKS

SEQ ID NO: 2180 - protein, 109 aa, Artificial Sequence; identical to SEQ ID NO: 1142
  Description of Artificial Sequence: Synthetic polypeptide

SEQ ID NO: 2181 - protein, 142 aa, Artificial Sequence
  Description of Artificial Sequence: Synthetic polypeptide
EVQLLESGGGLVQPGGSLRLSCAASGFTFSDYMMTWVRQAPGKGLQWVSYISPSGGLTSYADSVKGRFTISRDNSKNTLYLQMNSLRAEDTAVYYCARVARGIAARSRTSYFDYWGQGTLVTVSSASTKGPSVFPLAPSSKS

SEQ ID NO: 2182 - protein, 109 aa, Artificial Sequence; identical to SEQ ID NO: 1142
  Description of Artificial Sequence: Synthetic polypeptide

SEQ ID NO: 2183 - protein, 142 aa, Artificial Sequence
  Description of Artificial Sequence: Synthetic polypeptide
EVQLLESGGGLVQPGGSLRLSCAASGFTFSTYMMQWVRQAPGKGLEWVSYIGPSGGKTDYADSVKGRFTISRDNSKNTLYLQMNSLRAEDTAVYYCARVARGIAARSRTSYFDYWGQGTLVTVSSASTKGPSVFPLAPSSKS

SEQ ID NO: 2184 - protein, 109 aa, Artificial Sequence; identical to SEQ ID NO: 1142
  Description of Artificial Sequence: Synthetic polypeptide

SEQ ID NO: 2185 - protein, 142 aa, Artificial Sequence
  Description of Artificial Sequence: Synthetic polypeptide
EVQLLESGGGLVQPGGSLRLSCAASGFTFSTYLMAWVRQAPGKGLEWVSGIVSSGGRTLYADSVKGRFTISRDNSKNTLYLQMNSLRAEDTAVYYCARVARGIAARSRTSYFDYWGQGTLVTVSSASTKGPSVFPLAPSSKS

SEQ ID NO: 2186 - protein, 109 aa, Artificial Sequence; identical to SEQ ID NO: 1142
  Description of Artificial Sequence: Synthetic polypeptide

SEQ ID NO: 2187 - protein, 142 aa, Artificial Sequence
  Description of Artificial Sequence: Synthetic polypeptide
EVQLLESGGGLVQPGGSLRLSCAASGFTFSQYDMIWVRQAPGKGLEWVSYISSSGGFTRYADSVKGRFTISRDNSKNTLYLQMNSLRAEDTAVYYCARVARGIAARSRTSYFDYWGQGTLVTVSSASTKGPSVFPLAPSSKS

SEQ ID NO: 2188 - protein, 109 aa, Artificial Sequence; identical to SEQ ID NO: 1142
  Description of Artificial Sequence: Synthetic polypeptide

SEQ ID NO: 2189 - protein, 142 aa, Artificial Sequence
  Description of Artificial Sequence: Synthetic polypeptide
EVQLLESGGGLVQPGGSLRLSCAASGFTFSNYDMIWVRQAPGKGLEWVSSISSSGGTTKYADSVKGRFTISRDNSKNTLYLQMNSLRAEDTAVYYCARVARGIAARSRTSYFDYWGQGTLVTVSSASTKGPSVFPLAPSSKS

SEQ ID NO: 2190 - protein, 109 aa, Artificial Sequence; identical to SEQ ID NO: 1142
  Description of Artificial Sequence: Synthetic polypeptide

SEQ ID NO: 2191 - protein, 142 aa, Artificial Sequence
  Description of Artificial Sequence: Synthetic polypeptide
EVQLLESGGGLVQPGGSLRLSCAASGFTFSQYMMMWVRQAPGKGLEWVSRISPSGGSTLYADSVKGRFTISRDNSKNTLYLQMNSLRAEDTAVYYCARVARGIAARSRTSYFDYWGQGTLVTVSSASTKGPSVFPLAPSSKS

SEQ ID NO: 2192 - protein, 109 aa, Artificial Sequence; identical to SEQ ID NO: 1142
  Description of Artificial Sequence: Synthetic polypeptide

SEQ ID NO: 2193 - protein, 142 aa, Artificial Sequence
  Description of Artificial Sequence: Synthetic polypeptide
EVQLLESGGGLVQPGGSLRLSCAASGFTFSTYKMQWVRQAPGKGLEWVSSISPSGGPTNYADSVKGRFTISRDNSKNTLYLQMNSLRAEDTAVYYCARVARGIAARSRTSYFDYWGQGTLVTVSSASTKGPSVFPLAPSSKS

SEQ ID NO: 2194 - protein, 109 aa, Artificial Sequence; identical to SEQ ID NO: 1142
  Description of Artificial Sequence: Synthetic polypeptide

SEQ ID NO: 2195 - protein, 142 aa, Artificial Sequence
  Description of Artificial Sequence: Synthetic polypeptide
EVQLLESGGGLVQPGGSLRLSCAASGFTFSNYTMGWVRQAPGKGLEWVSSISPSGGKTDYADSVKGRFTISRDNSKNTLYLQMNSLRAEDTAVYYCARVARGIAARSRTSYFDYWGQGTLVTVSSASTKGPSVFPLAPSSKS

SEQ ID NO: 2196 - protein, 109 aa, Artificial Sequence; identical to SEQ ID NO: 1142
  Description of Artificial Sequence: Synthetic polypeptide

SEQ ID NO: 2197 - protein, 142 aa, Artificial Sequence
  Description of Artificial Sequence: Synthetic polypeptide
EVQLLESGGGLVQPGGSLRLSCAASGFTFSSQQMVWVRQAPGKGLEWVSYISPSGGNTYYADSVKGRFTISRDNSKNTLYLQMNSLRAEDTAVYYCARVARGIAARSRTSYFDYWGQGTLVTVSSASTKGPSVFPLAPSSKS

SEQ ID NO: 2198 - protein, 109 aa, Artificial Sequence; identical to SEQ ID NO: 1142
  Description of Artificial Sequence: Synthetic polypeptide

SEQ ID NO: 2199 - protein, 142 aa, Artificial Sequence
  Description of Artificial Sequence: Synthetic polypeptide
EVQLLESGGGLVQPGGSLRLSCAASGFTFSNYTMQWVRQAPGKGLQWVSYISPSGGYTGYADSVKGRFTISRDNSKNTLYLQMNSLRAEDTAVYYCARVARGIAARSRTSYFDYWGQGTLVTVSSASTKGPSVFPLAPSSKS

SEQ ID NO: 2200 - protein, 109 aa, Artificial Sequence; identical to SEQ ID NO: 1142
  Description of Artificial Sequence: Synthetic polypeptide

SEQ ID NO: 2201 - protein, 142 aa, Artificial Sequence
  Description of Artificial Sequence: Synthetic polypeptide
EVQLLESGGGLVQPGGSLRLSCAASGFTFSDYMMMWVRQAPGKGLEWVSSIVPSGGHTQYADSVKGRFTISRDNSKNTLYLQMNSLRAEDTAVYYCARVARGIAARSRTSYFDYWGQGTLVTVSSASTKGPSVFPLAPSSKS

SEQ ID NO: 2202 - protein, 109 aa, Artificial Sequence; identical to SEQ ID NO: 1142
  Description of Artificial Sequence: Synthetic polypeptide

SEQ ID NO: 2203 - protein, 142 aa, Artificial Sequence
  Description of Artificial Sequence: Synthetic polypeptide
EVQLLESGGGLVQPGGSLRLSCAASGFTFSNYMMGWVRQAPGKGLQWVSSISPSGGLTKYADSVKGRFTISRDNSKNTLYLQMNSLRAEDTAVYYCARVARGIAARSRTSYFDYWGQGTLVTVSSASTKGPSVFPLAPSSKS

SEQ ID NO: 2204 - protein, 109 aa, Artificial Sequence; identical to SEQ ID NO: 1142
  Description of Artificial Sequence: Synthetic polypeptide

SEQ ID NO: 2205 - protein, 142 aa, Artificial Sequence
  Description of Artificial Sequence: Synthetic polypeptide
EVQLLESGGGLVQPGGSLRLSCAASGFTFSQYLMAWVRQAPGKGLEWVSSIYPSGGWTKYADSVKGRFTISRDNSKNTLYLQMNSLRAEDTAVYYCARVARGIAARSRTSYFDYWGQGTLVTVSSASTKGPSVFPLAPSSKS

SEQ ID NO: 2206 - protein, 109 aa, Artificial Sequence; identical to SEQ ID NO: 1142
  Description of Artificial Sequence: Synthetic polypeptide

SEQ ID NO: 2207 - protein, 142 aa, Artificial Sequence
  Description of Artificial Sequence: Synthetic polypeptide
EVQLLESGGGLVQPGGSLRLSCAASGFTFSQYMMVWVRQAPGKGLEWVSSIYSSGGNTPYADSVKGRFTISRDNSKNTLYLQMNSLRAEDTAVYYCARVARGIAARSRTSYFDYWGQGTLVTVSSASTKGPSVFPLAPSSKS

SEQ ID NO: 2208 - protein, 109 aa, Artificial Sequence; identical to SEQ ID NO: 1142
  Description of Artificial Sequence: Synthetic polypeptide

SEQ ID NO: 2209 - protein, 142 aa, Artificial Sequence
  Description of Artificial Sequence: Synthetic polypeptide
EVQLLESGGGLVQPGGSLRLSCAASGFTFSEYMMMWVRQAPGKGLEWVSVISPSGGQTHYADSVKGRFTISRDNSKNTLYLQMNSLRAEDTAVYYCARVARGIAARSRTSYFDYWGQGTLVTVSSASTKGPSVFPLAPSSKS

SEQ ID NO: 2210 - protein, 109 aa, Artificial Sequence; identical to SEQ ID NO: 1142
  Description of Artificial Sequence: Synthetic polypeptide

SEQ ID NO: 2211 - protein, 142 aa, Artificial Sequence
  Description of Artificial Sequence: Synthetic polypeptide
EVQLLESGGGLVQPGGSLRLSCAASGFTFSGYMMVWVRQAPGKGLEWVSRISPSGGPTIYADSVKGRFTISRDNSKNTLYLQMNSLRAEDTAVYYCARVARGIAARSRTSYFDYWGQGTLVTVSSASTKGPSVFPLAPSSKS

SEQ ID NO: 2212 - protein, 109 aa, Artificial Sequence; identical to SEQ ID NO: 1142
  Description of Artificial Sequence: Synthetic polypeptide

SEQ ID NO: 2213 - protein, 142 aa, Artificial Sequence
  Description of Artificial Sequence: Synthetic polypeptide
EVQLLESGGGLVQPGGSLRLSCAASGFTFSVYMMSWVRQAPGKGLEWVSSIVPSGGSTTYADSVKGRFTISRDNSKNTLYLQMNSLRAEDTAVYYCARVARGIAARSRTSYFDYWGQGTLVTVSSASTKGPSVFPLAPSSKS

SEQ ID NO: 2214 - protein, 109 aa, Artificial Sequence; identical to SEQ ID NO: 1142
  Description of Artificial Sequence: Synthetic polypeptide

SEQ ID NO: 2215 - protein, 142 aa, Artificial Sequence
  Description of Artificial Sequence: Synthetic polypeptide
EVQLLESGGGLVQPGGSLRLSCAASGFTFSEYMMVWVRQAPGKGLEWVSRISPSGGTTEYADSVKGRFTISRDNSKNTLYLQMNSLRAEDTAVYYCARVARGIAARSRTSYFDYWGQGTLVTVSSASTKGPSVFPLAPSSKS

SEQ ID NO: 2216 - protein, 109 aa, Artificial Sequence; identical to SEQ ID NO: 1142
  Description of Artificial Sequence: Synthetic polypeptide

SEQ ID NO: 2217 - protein, 142 aa, Artificial Sequence
  Description of Artificial Sequence: Synthetic polypeptide
EVQLLESGGGLVQPGGSLRLSCAASGFTFSSYMMVWVRQAPGKGLEWVSSISPSGGYTIQADSVKGRFTISRDNSKNTLYLQMNSLRAEDTAVYYCARVARGIAARSRTSYFDYWGQGTLVTVSSASTKGPSVFPLAPSSKS

SEQ ID NO: 2218 - protein, 109 aa, Artificial Sequence; identical to SEQ ID NO: 1142
  Description of Artificial Sequence: Synthetic polypeptide

SEQ ID NO: 2219 - protein, 142 aa, Artificial Sequence
  Description of Artificial Sequence: Synthetic polypeptide
EVQLLESGGGLVQPGGSLRLSCAASGFTFSGYKMQWVRQAPGKGLEWVSSISPSGGITMYADSVKGRFTISRDNSKNTLYLQMNSLRAEDTAVYYCARVARGIAARSRTSYFDYWGQGTLVTVSSASTKGPSVFPLAPSSKS

SEQ ID NO: 2220 - protein, 109 aa, Artificial Sequence; identical to SEQ ID NO: 1142
  Description of Artificial Sequence: Synthetic polypeptide

SEQ ID NO: 2221 - protein, 142 aa, Artificial Sequence
  Description of Artificial Sequence: Synthetic polypeptide
EVQLLESGGGLVQPGGSLRLSCAASGFTFSDYMMAWVRQAPGKGLEWVSSIVPSGGHTHYADSVKGRFTISRDNSKNTLYLQMNSLRAEDTAVYYCARVARGIAARSRTSYFDYWGQGTLVTVSSASTKGPSVFPLAPSSKS

SEQ ID NO: 2222 - protein, 109 aa, Artificial Sequence; identical to SEQ ID NO: 1142
  Description of Artificial Sequence: Synthetic polypeptide

SEQ ID NO: 2223 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGISARSRTSCFDYWGQGTLVTVSSASTKGPSVFPLAPSSKS

SEQ ID NO: 2224 - protein, 109 aa, Artificial Sequence; identical to SEQ ID NO: 1142
  Description of Artificial Sequence: Synthetic polypeptide

SEQ ID NO: 2225 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTALYYCARVARGIAARSRTINLDYWGQGTLVTVSSASTKGPSVFPLAPSSKS

SEQ ID NO: 2226 - protein, 109 aa, Artificial Sequence; identical to SEQ ID NO: 1142
  Description of Artificial Sequence: Synthetic polypeptide

SEQ ID NO: 2227 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRSFDYWGQGTLVTVSSASTKGPSVFPLAPSSKS

SEQ ID NO: 2228 - protein, 109 aa, Artificial Sequence; identical to SEQ ID NO: 1142
  Description of Artificial Sequence: Synthetic polypeptide

SEQ ID NO: 2229 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVGRGIAARSRTSYFDKWGQGTLVTVSSASTKGPSVFPLAPSSKS

SEQ ID NO: 2230 - protein, 109 aa, Artificial Sequence; identical to SEQ ID NO: 1142
  Description of Artificial Sequence: Synthetic polypeptide

SEQ ID NO: 2231 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSQFDHWGQGTLVTVSSASTKGPSVFPLAPSSKS

SEQ ID NO: 2232 - protein, 109 aa, Artificial Sequence; identical to SEQ ID NO: 1142
  Description of Artificial Sequence: Synthetic polypeptide

SEQ ID NO: 2233 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSFFDQWGQGTLVTVSSASTKGPSVFPLAPSSKS

SEQ ID NO: 2234 - protein, 109 aa, Artificial Sequence; identical to SEQ ID NO: 1142
  Description of Artificial Sequence: Synthetic polypeptide

SEQ ID NO: 2235 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSFIDYWGQGTLVTVSSASTKGPSVFPLAPSSKS

SEQ ID NO: 2236 - protein, 109 aa, Artificial Sequence; identical to SEQ ID NO: 1142
  Description of Artificial Sequence: Synthetic polypeptide

SEQ ID NO: 2237 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARLARGIAARSRTSYQDIWGQGTLVTVSSASTKGPSVFPLAPSSKS

SEQ ID NO: 2238 - protein, 109 aa, Artificial Sequence; identical to SEQ ID NO: 1142
  Description of Artificial Sequence: Synthetic polypeptide

SEQ ID NO: 2239 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGISARSRTSYFDYWGQGTLVTVSSASTKGPSVFPLAPSSKS

SEQ ID NO: 2240 - protein, 109 aa, Artificial Sequence; identical to SEQ ID NO: 1142
  Description of Artificial Sequence: Synthetic polypeptide

SEQ ID NO: 2241 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSFFDYWGQGTLVTVSSASTKGPSVFPLAPSSKS

SEQ ID NO: 2242 - protein, 109 aa, Artificial Sequence; identical to SEQ ID NO: 1142
  Description of Artificial Sequence: Synthetic polypeptide

SEQ ID NO: 2243 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDQWGQGTLVTVSSASTKGPSVFPLAPSSKS

SEQ ID NO: 2244 - protein, 109 aa, Artificial Sequence; identical to SEQ ID NO: 1142
  Description of Artificial Sequence: Synthetic polypeptide

SEQ ID NO: 2245 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIADRSRTSYSDYWGQGTLVTVSSASTKGPSVFPLAPSSKS

SEQ ID NO: 2246 - protein, 109 aa, Artificial Sequence; identical to SEQ ID NO: 1142
  Description of Artificial Sequence: Synthetic polypeptide

SEQ ID NO: 2247 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYLDYWGQGTLVTVSSASTKGPSVFPLAPSSKS

SEQ ID NO: 2248 - protein, 109 aa, Artificial Sequence; identical to SEQ ID NO: 1142
  Description of Artificial Sequence: Synthetic polypeptide

SEQ ID NO: 2249 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIASRSRTRYCDYWGQGTLVTVSSASTKGPSVFPLAPSSKS

SEQ ID NO: 2250 - protein, 109 aa, Artificial Sequence; identical to SEQ ID NO: 1142
  Description of Artificial Sequence: Synthetic polypeptide

SEQ ID NO: 2251 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIVARSRTSNFDQWGQGTLVTVSSASTKGPSVFPLAPSSKS

SEQ ID NO: 2252 - protein, 109 aa, Artificial Sequence; identical to SEQ ID NO: 1142
  Description of Artificial Sequence: Synthetic polypeptide

SEQ ID NO: 2253 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGIVARSRTSYLHQWGQGTLVTVSSASTKGPSVFPLAPSSKS

SEQ ID NO: 2254 - protein, 109 aa, Artificial Sequence; identical to SEQ ID NO: 1142
  Description of Artificial Sequence: Synthetic polypeptide

SEQ ID NO: 2255 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRYIDQWGQGTLVTVSSASTKGPSVFPLAPSSKS

SEQ ID NO: 2256 - protein, 109 aa, Artificial Sequence; identical to SEQ ID NO: 1142
  Description of Artificial Sequence: Synthetic polypeptide

SEQ ID NO: 2257 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAYRRRTSYFDYWGQGTLVTVSSASTKGPSVFPLAPSSKS

SEQ ID NO: 2258 - protein, 109 aa, Artificial Sequence; identical to SEQ ID NO: 1142
  Description of Artificial Sequence: Synthetic polypeptide

SEQ ID NO: 2259 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCAMVGQGIRGRSRTSYFAQWGQGTLVTVSSASTKGPSVFPLAPSSKS

SEQ ID NO: 2260 - protein, 109 aa, Artificial Sequence; identical to SEQ ID NO: 1142
  Description of Artificial Sequence: Synthetic polypeptide

SEQ ID NO: 2261 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVGRGIAARSRTSQLDYWGQGTLVTVSSASTKGPSVFPLAPSSKS

SEQ ID NO: 2262 - protein, 109 aa, Artificial Sequence; identical to SEQ ID NO: 1142
  Description of Artificial Sequence: Synthetic polypeptide

SEQ ID NO: 2263 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGITARSRTSYFDDWGQGTLVTVSSASTKGPSVFPLAPSSKS

SEQ ID NO: 2264 - protein, 109 aa, Artificial Sequence; identical to SEQ ID NO: 1142
  Description of Artificial Sequence: Synthetic polypeptide

SEQ ID NO: 2265 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVGRGIAARSRTSFFDQWGQGTLVTVSSASTKGPSVFPLAPSSKS

SEQ ID NO: 2266 - protein, 109 aa, Artificial Sequence; identical to SEQ ID NO: 1142
  Description of Artificial Sequence: Synthetic polypeptide

SEQ ID NO: 2267 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCATVARGIAARSRTSYFDQWGQGTLVTVSSASTKGPSVFPLAPSSKS

SEQ ID NO: 2268 - protein, 109 aa, Artificial Sequence; identical to SEQ ID NO: 1142
  Description of Artificial Sequence: Synthetic polypeptide

SEQ ID NO: 2269 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTILLDQWGQGTLVTVSSASTKGPSVFPLAPSSKS

SEQ ID NO: 2270 - protein, 109 aa, Artificial Sequence; identical to SEQ ID NO: 1142
  Description of Artificial Sequence: Synthetic polypeptide

SEQ ID NO: 2271 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARQARGIAARSRTSYFDYWGQGTLVTVSSASTKGPSVFPLAPSSKS

SEQ ID NO: 2272 - protein, 109 aa, Artificial Sequence; identical to SEQ ID NO: 1142
  Description of Artificial Sequence: Synthetic polypeptide

SEQ ID NO: 2273 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYLDQWSQGTLVTVSSASTKGPSVFPLAPSSKS

SEQ ID NO: 2274 - protein, 109 aa, Artificial Sequence; identical to SEQ ID NO: 1142
  Description of Artificial Sequence: Synthetic polypeptide

SEQ ID NO: 2275 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGISGRSRLSYVDYWGQGTLVTVSSASTKGPSVFPLAPSSKS

SEQ ID NO: 2276 - protein, 109 aa, Artificial Sequence; identical to SEQ ID NO: 1142
  Description of Artificial Sequence: Synthetic polypeptide

SEQ ID NO: 2277 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDTWGQGTLVTVSSASTKGPSVFPLAPSSKS

SEQ ID NO: 2278 - protein, 109 aa, Artificial Sequence; identical to SEQ ID NO: 1142
  Description of Artificial Sequence: Synthetic polypeptide

SEQ ID NO: 2279 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGIAARSRTTQFDYWGQGTLVTVSSASTKGPSVFPLAPSSKS

SEQ ID NO: 2280 - protein, 109 aa, Artificial Sequence; identical to SEQ ID NO: 1142
  Description of Artificial Sequence: Synthetic polypeptide

SEQ ID NO: 2281 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARQRTSYYDYWGQGTLVTVSSASTKGPSVFPLAPSSKS

SEQ ID NO: 2282 - protein, 109 aa, Artificial Sequence; identical to SEQ ID NO: 1142
  Description of Artificial Sequence: Synthetic polypeptide

SEQ ID NO: 2283 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTVYFDHWGQGTLVTVSSASTKGPSVFPLAPSSKS

SEQ ID NO: 2284 - protein, 109 aa, Artificial Sequence; identical to SEQ ID NO: 1142
  Description of Artificial Sequence: Synthetic polypeptide

SEQ ID NO: 2285 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSQFDYWGQGTLVTVSSASTKGPSVFPLAPSSKS

SEQ ID NO: 2286 - protein, 109 aa, Artificial Sequence; identical to SEQ ID NO: 1142
  Description of Artificial Sequence: Synthetic polypeptide

SEQ ID NO: 2287 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCASVARGIAARSRTSYFNQWGQGTLVTVSSASTKGPSVFPLAPSSKS

SEQ ID NO: 2288 - protein, 109 aa, Artificial Sequence; identical to SEQ ID NO: 1142
  Description of Artificial Sequence: Synthetic polypeptide

SEQ ID NO: 2289 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGIAARSRTSSVDQWGQGTLVTVSSASTKGPSVFPLAPSSKS

SEQ ID NO: 2290 - protein, 109 aa, Artificial Sequence; identical to SEQ ID NO: 1142
  Description of Artificial Sequence: Synthetic polypeptide

SEQ ID NO: 2291 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVATGIVARSRTRYFDQWGQGTLVTVSSASTKGPSVFPLAPSSKS

SEQ ID NO: 2292 - protein, 109 aa, Artificial Sequence; identical to SEQ ID NO: 1142
  Description of Artificial Sequence: Synthetic polypeptide

SEQ ID NO: 2293 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYLDFWGQGTLVTVSSASTKGPSVFPLAPSSKS

SEQ ID NO: 2294 - protein, 109 aa, Artificial Sequence; identical to SEQ ID NO: 1142
  Description of Artificial Sequence: Synthetic polypeptide

SEQ ID NO: 2295 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRNSQQDYWGQGTLVTVSSASTKGPSVFPLAPSSKS

SEQ ID NO: 2296 - protein, 109 aa, Artificial Sequence; identical to SEQ ID NO: 1142
  Description of Artificial Sequence: Synthetic polypeptide

SEQ ID NO: 2297 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRYFDYWGQGTLVTVSSASTKGPSVFPLAPSSKS

SEQ ID NO: 2298 - protein, 109 aa, Artificial Sequence; identical to SEQ ID NO: 1142
  Description of Artificial Sequence: Synthetic polypeptide

SEQ ID NO: 2299 - protein, 142 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTRYFDQWGQGTLVTVSSASTKGPSVFPLAPSSKS

SEQ ID NO: 2300 - protein, 60 aa, Artificial Sequence
  Description of Artificial Sequence: Synthetic polypeptide
EAMHSFCAFKADDGPCRAAHPRWFFNIFTRQCEEFSYGGCGGNQNRFESLEECKKMCTRD

SEQ ID NO: 2301 - protein, 12 aa, Artificial Sequence
  Description of Artificial Sequence: Synthetic peptide
RTSQFVNSNYLA

SEQ ID NO: 2302 - protein, 7 aa, Artificial Sequence
  Description of Artificial Sequence: Synthetic peptide
GASSRAT

SEQ ID NO: 2303 - protein, 9 aa, Artificial Sequence
  Description of Artificial Sequence: Synthetic peptide
QQSSRTPWT

SEQ ID NO: 2304 - protein, 5 aa, Artificial Sequence
  Description of Artificial Sequence: Synthetic peptide
HYLMT

SEQ ID NO: 2305 - protein, 17 aa, Artificial Sequence
  Description of Artificial Sequence: Synthetic peptide
YISPSGGHTIYADSVKG

SEQ ID NO: 2306 - protein, 16 aa, Artificial Sequence
  Description of Artificial Sequence: Synthetic peptide
VARGIAARSRTSYFDY

SEQ ID NO: 2307 - protein, 12 aa, Artificial Sequence
  Description of Artificial Sequence: Synthetic peptide
RTSQFVNSNYLA

SEQ ID NO: 2308 - protein, 7 aa, Artificial Sequence
  Description of Artificial Sequence: Synthetic peptide
GASSRAT

SEQ ID NO: 2309 - protein, 9 aa, Artificial Sequence
  Description of Artificial Sequence: Synthetic peptide
QQSSRTPWT

SEQ ID NO: 2310 - protein, 5 aa, Artificial Sequence
  Description of Artificial Sequence: Synthetic peptide
HYLMT

SEQ ID NO: 2311 - protein, 17 aa, Artificial Sequence
  Description of Artificial Sequence: Synthetic peptide
YISPSGGHTIYADSVKG

SEQ ID NO: 2312 - protein, 16 aa, Artificial Sequence
  Description of Artificial Sequence: Synthetic peptide
VGQGIRGRSRTSYFAQ

SEQ ID NO: 2313 - protein, 12 aa, Artificial Sequence
  Description of Artificial Sequence: Synthetic peptide
RTSQFVNSNYLA

SEQ ID NO: 2314 - protein, 7 aa, Artificial Sequence
  Description of Artificial Sequence: Synthetic peptide
GASSRAT

SEQ ID NO: 2315 - protein, 9 aa, Artificial Sequence
  Description of Artificial Sequence: Synthetic peptide
QQSSRTPWT

SEQ ID NO: 2316 - protein, 5 aa, Artificial Sequence
  Description of Artificial Sequence: Synthetic peptide
DYMMA

SEQ ID NO: 2317 - protein, 17 aa, Artificial Sequence
  Description of Artificial Sequence: Synthetic peptide
SIVPSGGHTHYADSVKG

SEQ ID NO: 2318 - protein, 16 aa, Artificial Sequence
  Description of Artificial Sequence: Synthetic peptide
VARGIAARSRTSYFDY

SEQ ID NO: 2319 - protein, 12 aa, Artificial Sequence
  Description of Artificial Sequence: Synthetic peptide
RTSQFVNSNYLA

SEQ ID NO: 2320 - protein, 7 aa, Artificial Sequence
  Description of Artificial Sequence: Synthetic peptide
GASSRAT

SEQ ID NO: 2321 - protein, 9 aa, Artificial Sequence
  Description of Artificial Sequence: Synthetic peptide
QQSSRTPWT

SEQ ID NO: 2322 - protein, 5 aa, Artificial Sequence
  Description of Artificial Sequence: Synthetic peptide
HYLMT

SEQ ID NO: 2323 - protein, 17 aa, Artificial Sequence
  Description of Artificial Sequence: Synthetic peptide
YISPSGGHTIYADSVKG

SEQ ID NO: 2324 - protein, 16 aa, Artificial Sequence
  Description of Artificial Sequence: Synthetic peptide
VAQGIAARSRTSSVDQ

SEQ ID NO: 2325 - protein, 12 aa, Artificial Sequence
  Description of Artificial Sequence: Synthetic peptide
RTSQFVNSNYLA

SEQ ID NO: 2326 - protein, 7 aa, Artificial Sequence
  Description of Artificial Sequence: Synthetic peptide
GASSRAT

SEQ ID NO: 2327 - protein, 9 aa, Artificial Sequence
  Description of Artificial Sequence: Synthetic peptide
QQSSRTPWT

SEQ ID NO: 2328 - protein, 5 aa, Artificial Sequence
  Description of Artificial Sequence: Synthetic peptide
HYLMT

SEQ ID NO: 2329 - protein, 17 aa, Artificial Sequence
  Description of Artificial Sequence: Synthetic peptide
YISPSGGHTIYADSVKG

SEQ ID NO: 2330 - protein, 16 aa, Artificial Sequence
  Description of Artificial Sequence: Synthetic peptide
VAQGISARSRTSYFDY

SEQ ID NO: 2331 - protein, 11 aa, Artificial Sequence
  Description of Artificial Sequence: Synthetic peptide
RASQSISSWLA

SEQ ID NO: 2332 - protein, 7 aa, Artificial Sequence
  Description of Artificial Sequence: Synthetic peptide
KASTLES

SEQ ID NO: 2333 - protein, 8 aa, Artificial Sequence
  Description of Artificial Sequence: Synthetic peptide
QQYNTYWT

SEQ ID NO: 2334 - protein, 5 aa, Artificial Sequence
  Description of Artificial Sequence: Synthetic peptide
HYIMM

SEQ ID NO: 2335 - protein, 17 aa, Artificial Sequence
  Description of Artificial Sequence: Synthetic peptide
GIYSSGGITVYADSVKG

SEQ ID NO: 2336 - protein, 13 aa, Artificial Sequence
  Description of Artificial Sequence: Synthetic peptide
RRTGIPRRDAFDI

SEQ ID NO: 2337 - protein, 11 aa, Artificial Sequence
  Description of Artificial Sequence: Synthetic peptide
RASQSISSWLA

SEQ ID NO: 2338 - protein, 7 aa, Artificial Sequence
  Description of Artificial Sequence: Synthetic peptide
KASTLES

SEQ ID NO: 2339 - protein, 8 aa, Artificial Sequence
  Description of Artificial Sequence: Synthetic peptide
QQYNTYWT

SEQ ID NO: 2340 - protein, 5 aa, Artificial Sequence
  Description of Artificial Sequence: Synthetic peptide
HYIMM

SEQ ID NO: 2341 - protein, 17 aa, Artificial Sequence
  Description of Artificial Sequence: Synthetic peptide
GIYSSGGITVYADSVKG

SEQ ID NO: 2342 - protein, 13 aa, Artificial Sequence
  Description of Artificial Sequence: Synthetic peptide
RRIGVPRRDSFDM

SEQ ID NO: 2343 - protein, 11 aa, Artificial Sequence
  Description of Artificial Sequence: Synthetic peptide
RASQSISSWLA

SEQ ID NO: 2344 - protein, 7 aa, Artificial Sequence
  Description of Artificial Sequence: Synthetic peptide
KASTLES

SEQ ID NO: 2345 - protein, 8 aa, Artificial Sequence
  Description of Artificial Sequence: Synthetic peptide
QQYNTYWT

SEQ ID NO: 2346 - protein, 5 aa, Artificial Sequence
  Description of Artificial Sequence: Synthetic peptide
IYSMH

SEQ ID NO: 2347 - protein, 17 aa, Artificial Sequence
  Description of Artificial Sequence: Synthetic peptide
SIYPSRGMTWYADSVKG

SEQ ID NO: 2348 - protein, 13 aa, Artificial Sequence
  Description of Artificial Sequence: Synthetic peptide
RRTGIPRRDAFDI

SEQ ID NO: 2349 - protein, 11 aa, Artificial Sequence
  Description of Artificial Sequence: Synthetic peptide
RASQSISSWLA

SEQ ID NO: 2350 - protein, 7 aa, Artificial Sequence
  Description of Artificial Sequence: Synthetic peptide
KASTLES

SEQ ID NO: 2351 - protein, 8 aa, Artificial Sequence
  Description of Artificial Sequence: Synthetic peptide
QQYNTYWT

SEQ ID NO: 2352 - protein, 5 aa, Artificial Sequence
  Description of Artificial Sequence: Synthetic peptide
HYIMM

SEQ ID NO: 2353 - protein, 17 aa, Artificial Sequence
  Description of Artificial Sequence: Synthetic peptide
GIYSSGGITVYADSVKG

SEQ ID NO: 2354 - protein, 13 aa, Artificial Sequence
  Description of Artificial Sequence: Synthetic peptide
RRIGVPRRDEFDI

SEQ ID NO: 2355 - protein, 11 aa, Artificial Sequence
  Description of Artificial Sequence: Synthetic peptide
RASQSISSWLA

SEQ ID NO: 2356 - protein, 7 aa, Artificial Sequence
  Description of Artificial Sequence: Synthetic peptide
KASTLES

SEQ ID NO: 2357 - protein, 8 aa, Artificial Sequence
  Description of Artificial Sequence: Synthetic peptide
QQYNTYWT

SEQ ID NO: 2358 - protein, 5 aa, Artificial Sequence
  Description of Artificial Sequence: Synthetic peptide
HYIMM

SEQ ID NO: 2359 - protein, 17 aa, Artificial Sequence
  Description of Artificial Sequence: Synthetic peptide
GIYSSGGITVYADSVKG

SEQ ID NO: 2360 - protein, 13 aa, Artificial Sequence
  Description of Artificial Sequence: Synthetic peptide
RRTGVPRRDEFDI

SEQ ID NO: 2361 - protein, 11 aa, Artificial Sequence
  Description of Artificial Sequence: Synthetic peptide
SGNKLGDKYVA

SEQ ID NO: 2362 - protein, 7 aa, Artificial Sequence
  Description of Artificial Sequence: Synthetic peptide
QDTKRPS

SEQ ID NO: 2363 - protein, 9 aa, Artificial Sequence
  Description of Artificial Sequence: Synthetic peptide
QAWDSSIVI

SEQ ID NO: 2364 - protein, 5 aa, Artificial Sequence
  Description of Artificial Sequence: Synthetic peptide
WYTMV

SEQ ID NO: 2365 - protein, 17 aa, Artificial Sequence
  Description of Artificial Sequence: Synthetic peptide
YIYPSGGATFYADSVKG

SEQ ID NO: 2366 - protein, 13 aa, Artificial Sequence
  Description of Artificial Sequence: Synthetic peptide
GSYDYIWGFYSDH

SEQ ID NO: 2367 - protein, 11 aa, Artificial Sequence
  Description of Artificial Sequence: Synthetic peptide
SGDKLGDKYTS

SEQ ID NO: 2368 - protein, 7 aa, Artificial Sequence
  Description of Artificial Sequence: Synthetic peptide
QDIKRPS

SEQ ID NO: 2369 - protein, 10 aa, Artificial Sequence
  Description of Artificial Sequence: Synthetic peptide
QAWDSPNARV

SEQ ID NO: 2370 - protein, 5 aa, Artificial Sequence
  Description of Artificial Sequence: Synthetic peptide
HYRMS

SEQ ID NO: 2371 - protein, 17 aa, Artificial Sequence
  Description of Artificial Sequence: Synthetic peptide
SIYPSGGRTVYADSVKG

SEQ ID NO: 2372 - protein, 19 aa, Artificial Sequence
  Description of Artificial Sequence: Synthetic peptide
DKFEWRLLFRGIGNDAFDI

SEQ ID NO: 2373 - protein, 11 aa, Artificial Sequence
  Description of Artificial Sequence: Synthetic peptide
RASQSIRNYLN

SEQ ID NO: 2374 - protein, 7 aa, Artificial Sequence
  Description of Artificial Sequence: Synthetic peptide
AASTLQS

SEQ ID NO: 2375 - protein, 9 aa, Artificial Sequence
  Description of Artificial Sequence: Synthetic peptide
QQLSGYPHT

SEQ ID NO: 2376 - protein, 5 aa, Artificial Sequence
  Description of Artificial Sequence: Synthetic peptide
FYYMV

SEQ ID NO: 2377 - protein, 17 aa, Artificial Sequence
  Description of Artificial Sequence: Synthetic peptide
VIYPSGGITVYADSVKG

SEQ ID NO: 2378 - protein, 16 aa, Artificial Sequence
  Description of Artificial Sequence: Synthetic peptide
DKWAVMPPYYYYAMDV

SEQ ID NO: 2379 - protein, 11 aa, Artificial Sequence
  Description of Artificial Sequence: Synthetic peptide
RASQSVSSYLA

SEQ ID NO: 2380 - protein, 7 aa, Artificial Sequence
  Description of Artificial Sequence: Synthetic peptide
DASNRAT

SEQ ID NO: 2381 - protein, 11 aa, Artificial Sequence
  Description of Artificial Sequence: Synthetic peptide
QQRSNWPRGFT

SEQ ID NO: 2382 - protein, 5 aa, Artificial Sequence
  Description of Artificial Sequence: Synthetic peptide
YYHMS

SEQ ID NO: 2383 - protein, 17 aa, Artificial Sequence
  Description of Artificial Sequence: Synthetic peptide
VISPSGGSTKYADSVKG

SEQ ID NO: 2384 - protein, 19 aa, Artificial Sequence
  Description of Artificial Sequence: Synthetic peptide
GGSSDYAWGSYRRPYYFDY

SEQ ID NO: 2385 - protein, 106 aa, Artificial Sequence; identical to SEQ ID NO: 247
  Description of Artificial Sequence: Synthetic polypeptide

SEQ ID NO: 2386 - protein, 107 aa, Artificial Sequence; identical to SEQ ID NO: 255
  Description of Artificial Sequence: Synthetic polypeptide

SEQ ID NO: 2387 - protein, 106 aa, Artificial Sequence
  Description of Artificial Sequence: Synthetic polypeptide
DIQMTQSPSTLSASVGDRVTITCRASQSISSWLAWYQQKPGKAPNLLIYKASTLESGVPSRFSGSGSGTEFTLTISSLQPDDFATYYCQQYNTYWTFGQGTKVEIK

SEQ ID NO: 2388 - protein, 108 aa, Artificial Sequence
  Description of Artificial Sequence: Synthetic polypeptide
EIVLTQSPGTLSLSPGERATLSCRTSQFVNSNYLAWYQQKPGQAPRLLIYGASSRATGIPDRFSGSGSGTDFTLTISRLEPEDFAVYYCQQSSRTPWTFGQGTKVEIK

SEQ ID NO: 2389 - protein, 106 aa, Artificial Sequence
  Description of Artificial Sequence: Synthetic polypeptide
DIQMTQSPSTLSASVGDRVTITCRASQSISSWLAWYQQKPGKAPKLLIYKASTLESGVPSRFSGSGSGTEFTLTISSLQPDDFATYYCQQYNTYWTFGQGTKVEIK

SEQ ID NO: 2390 - protein, 108 aa, Artificial Sequence; identical to SEQ ID NO: 2388
  Description of Artificial Sequence: Synthetic polypeptide

SEQ ID NO: 2391 - protein, 106 aa, Artificial Sequence; identical to SEQ ID NO: 2389
  Description of Artificial Sequence: Synthetic polypeptide

SEQ ID NO: 2392 - protein, 108 aa, Artificial Sequence; identical to SEQ ID NO: 2388
  Description of Artificial Sequence: Synthetic polypeptide

SEQ ID NO: 2393 - protein, 108 aa, Artificial Sequence; identical to SEQ ID NO: 2388
  Description of Artificial Sequence: Synthetic polypeptide

SEQ ID NO: 2394 - protein, 106 aa, Artificial Sequence; identical to SEQ ID NO: 2389
  Description of Artificial Sequence: Synthetic polypeptide

SEQ ID NO: 2395 - protein, 105 aa, Artificial Sequence
  Description of Artificial Sequence: Synthetic polypeptide
DIQMTQSPSTLSASVGDRVTITCRASQSISSWLAWYQQKPGKAPKLLIYKASTLESGVPSRFSGSGSGTEFTLTISSLQPDDFATYYCQQYNTYWTFGQGTKVEI

SEQ ID NO: 2396 - protein, 106 aa, Artificial Sequence; identical to SEQ ID NO: 2389
  Description of Artificial Sequence: Synthetic polypeptide

SEQ ID NO: 2397 - protein, 108 aa, Artificial Sequence; identical to SEQ ID NO: 2388
  Description of Artificial Sequence: Synthetic polypeptide

SEQ ID NO: 2398 - protein, 107 aa, Artificial Sequence
  Description of Artificial Sequence: Synthetic polypeptide
DIQMTQSPSSLSASVGDRVTITCRASQSIRNYLNWYQQKPGKAPNLLIYAASTLQSGVPARFSGSGSGTDFTLTISSLQPEDFATYYCQQLSGYPHTFGQGTKLEIK

SEQ ID NO: 2399 - protein, 110 aa, Artificial Sequence; identical to SEQ ID NO: 251
  Description of Artificial Sequence: Synthetic polypeptide

SEQ ID NO: 2400 - protein, 122 aa, Artificial Sequence
  Description of Artificial Sequence: Synthetic polypeptide
EVQLLESGGGLVQPGGSLRLSCAASGFTFSWYTMVWVRQAPGKGLEWVSYIYPSGGATFYADSVKGRFTISRDNSKNTLYLQMNSLRAEDTAVYYCAMGSYDYIWGFYSDHWGQGTLVTVSS

SEQ ID NO: 2401 - protein, 128 aa, Artificial Sequence
  Description of Artificial Sequence: Synthetic polypeptide
EVQLLESGGGLVQPGGSLRLSCAASGFTFSHYRMSWVRQAPGKGLEWVSSIYPSGGRTVYADSVKGRFTISRDNSKNTLYLQMNSLRAEDTAVYYCAKDKFEWRLLFRGIGNDAFDIWGQGTMVTVSS

SEQ ID NO: 2402 - protein, 122 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGIPRRDAFDIWGQGTMVTVSS

SEQ ID NO: 2403 - protein, 125 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVARGIAARSRTSYFDYWGQGTLVTVSS

SEQ ID NO: 2404 - protein, 122 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAWRRIGVPRRDSFDMWGQGTMVTVSS

SEQ ID NO: 2405 - protein, 125 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCAMVGQGIRGRSRTSYFAQWGQGTLVTVSS

SEQ ID NO: 2406 - protein, 122 aa, Artificial Sequence
  Description of Artificial Sequence: Synthetic polypeptide
EVQLLESGGGLVQPGGSLRLSCAASGFTFSIYSMHWVRQAPGKGLEWVSSIYPSRGMTWYADSVKGRFTISRDNSKNTLYLQMNSLRAEDTAVYYCAYRRTGIPRRDAFDIWGQGTMVTVSS

SEQ ID NO: 2407 - protein, 125 aa, Artificial Sequence
  Description of Artificial Sequence: Synthetic polypeptide
EVQLLESGGGLVQPGGSLRLSCAASGFTFSDYMMAWVRQAPGKGLEWVSSIVPSGGHTHYADSVKGRFTISRDNSKNTLYLQMNSLRAEDTAVYYCARVARGIAARSRTSYFDYWGQGTLVTVSS

SEQ ID NO: 2408 - protein, 125 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGIAARSRTSSVDQWGQGTLVTVSS

SEQ ID NO: 2409 - protein, 122 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSS

SEQ ID NO: 2410 - protein, 122 aa, Artificial Sequence; identical to SEQ ID NO: 2409
  Description of Artificial Sequence: Synthetic polypeptide

SEQ ID NO: 2411 - protein, 122 aa, Artificial Sequence
  Description of Artificial Sequence: Synthetic polypeptide
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRTGVPRRDEFDIWGQGTMVTVSS

SEQ ID NO: 2412 - protein, 125 aa, Artificial Sequence
  Description of Artificial Sequence: Synthetic polypeptide
EVQLLESGGGLVQPGGSLRLSCAASGFTFSHYLMTWVRQAPGKGLEWVSYISPSGGHTIYADSVKGRFTISRDNSKNTLYLQMNSLRAEDTAVYYCARVAQGISARSRTSYFDYWGQGTLVTVSS

SEQ ID NO: 2413 - protein, 125 aa, Artificial Sequence
  Description of Artificial Sequence: Synthetic polypeptide
EVQLLESGGGLVQPGGSLRLSCAASGFTFSFYYMVWVRQAPGKGLEWVSVIYPSGGITVYADSVKGRFTISRDNSKNTLYLQMNSLRAEDTAVYYCARDKWAVMPPYYYYAMDVWGQGTTVTVSS

SEQ ID NO: 2414 - protein, 128 aa, Artificial Sequence
  Description of Artificial Sequence: Synthetic polypeptide
EVQLLESGGGLVQPGGSLRLSCAASGFTFSYYHMSWVRQAPGKGLEWVSVISPSGGSTKYADSVKGRFTISRDNSKNTLYLQMNSLRAEDTAVYYCARGGSSDYAWGSYRRPYYFDYWGQGTLVTVSS

SEQ ID NO: 2415 - DNA, 318 bp, Artificial Sequence
  Description of Artificial Sequence: Synthetic polynucleotide
cagagcgctttgactcagccacccacagtgtctgtgtccccaggacagacagccaggatcacctgctctggaaataaattgggggataaatatgttgcctggtatcagcagaagccaggccagtcccctatgttggtcatctatcaagatactaagcgcccctcaagagtttctgagcgattctctggctccaactctgcgaatacagccactctgtccatcagcgggacccaggctctggatgaggctgactattactgtcaggcgtgggacagcagcattgtgatcttcggcggagggaccaggctgaccgtccta

SEQ ID NO: 2416 - DNA, 321 bp, Artificial Sequence
  Description of Artificial Sequence: Synthetic polynucleotide
cagagcgtcttgactcagccaccctcagtgtccgtgtctccaggacagacagccagcatcacctgctctggagataaattgggggataaatatacttcctggtatcagcagaggccaggccagtcccctgtattggtcatctatcaagatatcaagcggccctcagggatccctgagcgattctctggctccaactctgggaacacagccactctgaccatcagcgggacccaggctatggatgaggctgactattactgtcaggcgtgggacagtcccaatgcgagggtcttcggatctgggaccaaggtcaccgtccta

SEQ ID NO: 2417 - DNA, 318 bp, Artificial Sequence
  Description of Artificial Sequence: Synthetic polynucleotide
gacatccagatgacccagtctccttccaccctgtctgcatctgtaggagacagagtcaccatcacttgccgggccagtcagagtatcagtagttggttggcctggtatcagcagaaaccagggaaagcccctaacctcctgatctataaggcgtctactttagaaagtggggtcccatcaaggttcagcggcagtggatctgggacagaattcactctcaccatcagcagcctgcagcctgatgattttgcaacttattactgccaacagtataatacttattggacgttcggccaagggaccaaggtggaaatcaaa

SEQ ID NO: 2418 - DNA, 324 bp, Artificial Sequence
  Description of Artificial Sequence: Synthetic polynucleotide
gagatcgtgctgacccagtcccctggcaccctgtctctgtctcccggcgagagagccaccctgtcctgccggacctcccagttcgtgaactccaactacctggcttggtatcagcagaagccaggccaggcccctagactgctgatctacggcgcctcttccagagccaccggcatccctgaccggttctccggctctggctccggcaccgacttcaccctgaccatctcccggctggaacctgaggacttcgccgtgtactactgccagcagtcctcccggaccccttggacctttggccagggcaccaaggtggagatcaag

SEQ ID NO: 2419 - DNA, 318 bp, Artificial Sequence
  Description of Artificial Sequence: Synthetic polynucleotide
gacatccagatgacccagtccccctccaccctgtccgcctctgtgggcgacagagtgaccatcacctgtcgggcctcccagtccatctccagctggctggcctggtatcagcagaagcccggcaaggcccccaagctgctgatctacaaggccagcaccctggaatccggcgtgccctccagattctccggctctggctccggcaccgagttcaccctgaccatcagctccctgcagcccgacgacttcgccacctactactgccagcagtacaacacctactggaccttcggccagggcaccaaggtggaaatcaag

SEQ ID NO: 2420 - DNA, 324 bp, Artificial Sequence; identical to SEQ ID NO: 2418
  Description of Artificial Sequence: Synthetic polynucleotide

SEQ ID NO: 2421 - DNA, 318 bp, Artificial Sequence; identical to SEQ ID NO: 2419
  Description of Artificial Sequence: Synthetic polynucleotide

SEQ ID NO: 2422 - DNA, 324 bp, Artificial Sequence; identical to SEQ ID NO: 2418
  Description of Artificial Sequence: Synthetic polynucleotide

SEQ ID NO: 2423 - DNA, 324 bp, Artificial Sequence; identical to SEQ ID NO: 2418
  Description of Artificial Sequence: Synthetic polynucleotide

SEQ ID NO: 2424 - DNA, 318 bp, Artificial Sequence; identical to SEQ ID NO: 2419
  Description of Artificial Sequence: Synthetic polynucleotide

SEQ ID NO: 2425 - DNA, 318 bp, Artificial Sequence; identical to SEQ ID NO: 2419
  Description of Artificial Sequence: Synthetic polynucleotide

SEQ ID NO: 2426 - DNA, 324 bp, Artificial Sequence; identical to SEQ ID NO: 2418
  Description of Artificial Sequence: Synthetic polynucleotide

SEQ ID NO: 2427 - DNA, 321 bp, Artificial Sequence
  Description of Artificial Sequence: Synthetic polynucleotide
gacatccagatgacccagtctccatcctccctgtctgcatctgtaggagacagagtcaccatcacttgccgggcaagtcagagtattcgcaactatttaaattggtatcagcagaaaccagggaaagcccctaacctcctgatctatgctgcatccactttgcaaagtggggtcccagcaaggttcagtggcagtggatctgggacagatttcactctcactatcagcagtctgcagcctgaagattttgcaacttattactgtcaacagcttagtggttacccccacacttttggccaggggaccaagctggagatcaaa

SEQ ID NO: 2428 - DNA, 330 bp, Artificial Sequence
  Description of Artificial Sequence: Synthetic polynucleotide
caagacatccagatgacccagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcgcggattcactttcggccctgggaccaaagtggatatcaaa

SEQ ID NO: 2429 - DNA, 366 bp, Artificial Sequence
  Description of Artificial Sequence: Synthetic polynucleotide
gaagttcaattgttagagtctggtggcggtcttgttcagcctggtggttctttacgtctttcttgcgctgcttccggattcactttctcttggtacactatggtttgggttcgccaagctcctggtaaaggtttggagtgggtttcttatatctatccttctggtggcgctactttttatgctgactccgttaaaggtcgcttcactatctctagagacaactctaagaatactctctacttgcagatgaacagcttaagggctgaggacacggccgtgtattactgtgcgatgggttcatatgattacatttggggattttatagtgaccactggggccagggaaccctggtcaccgtctcaagc

SEQ ID NO: 2430 - DNA, 384 bp, Artificial Sequence
  Description of Artificial Sequence: Synthetic polynucleotide
gaagttcaattgttagagtctggtggcggtcttgttcagcctggtggttctttacgtctttcttgcgctgcttccggattcactttctctcattaccgtatgtcttgggttcgccaagctcctggtaaaggtttggagtgggtttcttctatctatccttctggtggccgtactgtttatgctgactccgttaaaggtcgcttcactatctctagagacaactctaagaatactctctacttgcagatgaacagcttaagggctgaggacacggccgtgtattactgtgcgaaagataagttcgagtggaggttattatttcgcgggattggaaatgatgcttttgatatctggggccaagggacaatggtcaccgtctcaagc

SEQ ID NO: 2431 - DNA, 366 bp, Artificial Sequence
  Description of Artificial Sequence: Synthetic polynucleotide
gaagttcaattgttagagtctggtggcggtcttgttcagcctggtggttctttacgtctttcttgcgctgcttccggattcactttctctcattacattatgatgtgggttcgccaagctcctggtaaaggtttggagtgggtttctggtatctattcttctggtggcattactgtttatgctgactccgttaaaggtcgcttcactatctctagagacaactctaagaatactctctacttgcagatgaacagcttaagggctgaggacacggccgtgtattactgtgcgtaccgccggactgggattccaagaagagatgcttttgatatctggggccaagggacaatggtcaccgtctcaagc

SEQ ID NO: 2432 - DNA, 375 bp, Artificial Sequence
  Description of Artificial Sequence: Synthetic polynucleotide
gaggtgcaattgctggaatccggcggaggtctggtgcagcctggcggctccctgagactgtcttgcgccgcctccggcttcaccttctcccactacctgatgacctgggtgcgccaggctcctggcaagggcctcgaatgggtgtcctacatctccccctctggcggccacaccatctacgccgactccgtgaagggccggttcaccatctcccgggacaactccaagaacaccctgtatctgcagatgaactccctgagggccgaggacaccgccgtgtactactgcgccagggtggccagaggaatcgccgccaggtcccggacctcctacttcgactactggggccagggcaccctggtgaccgtgtcctcc

SEQ ID NO: 2433 - DNA, 366 bp, Artificial Sequence
  Description of Artificial Sequence: Synthetic polynucleotide
gaggtgcaattgctggaatccggcggaggactggtgcagcctggcggctccctgagactgtcttgcgccgcctccggctttaccttctcccactacatcatgatgtgggtgcgacaggctccaggcaagggcctggaatgggtgtccggcatctactcctccggcggcatcaccgtgtacgccgactccgtgaagggccggttcaccatctcccgggacaactccaagaacaccctgtacctgcagatgaactccctgcgggccgaggacaccgccgtgtactactgtgcctggcggagaatcggcgtgcccagacgggactccttcgacatgtggggacagggcaccatggtgacagtgtcctcc

SEQ ID NO: 2434 - DNA, 375 bp, Artificial Sequence
  Description of Artificial Sequence: Synthetic polynucleotide
gaggtgcaattgctggaatccggcggaggactggtgcagcctggcggctccctgagactgtcttgcgccgcctccggcttcaccttctcccactacctgatgacctgggtgcgacaggctcctggcaaaggcctggaatgggtgtcctacatctccccctctggcggccacaccatctacgccgactccgtgaagggccggtttaccatctcccgggacaactccaagaacaccctgtacctgcagatgaactccctgcgggccgaggacaccgccgtgtactactgtgccatggtcggccagggaatccggggcagatcccggacctcctacttcgcccagtggggccagggcaccctggtgacagtgtcctct

SEQ ID NO: 2435 - DNA, 366 bp, Artificial Sequence
  Description of Artificial Sequence: Synthetic polynucleotide
gaggtgcaattgctggaatccggcggaggactggtgcagcctggcggctccctgagactgtcttgcgccgcctccggcttcaccttctccatctactccatgcactgggtgcgacaggctccaggcaagggcctggaatgggtgtcctccatctacccctcccggggcatgacttggtacgccgactccgtgaagggccggttcacaatctcccgggacaactccaagaacaccctgtacctgcagatgaactccctgcgggccgaggacaccgccgtgtactactgcgcctaccggcggaccggcatccctagacgggacgccttcgacatctgggggcagggcaccatggtgacagtgtcctcc

SEQ ID NO: 2436 - DNA, 375 bp, Artificial Sequence
  Description of Artificial Sequence: Synthetic polynucleotide
gaggtgcaattgctggaatccggcggtggactggtgcagcctggcggctccctgagactgtcttgcgccgcctccggcttcaccttctccgactacatgatggcctgggtgcgacaggcccctggcaagggactggaatgggtgtcctccatcgtgccctctggcggccacacccactacgccgactccgtgaagggccggttcaccatctcccgggacaactccaagaacaccctgtacctgcagatgaactccctgcgggccgaggacaccgccgtgtactactgcgccagagtggccagaggaatcgccgccagatcccggacctcctacttcgactactggggccagggcaccctggtgacagtgtcctcc

SEQ ID NO: 2437 - DNA, 375 bp, Artificial Sequence
  Description of Artificial Sequence: Synthetic polynucleotide
gaggtgcaattgctggaatccggcggaggactggtgcagcctggcggctccctgagactgtcttgcgccgcctccggcttcaccttctcccactacctgatgacctgggtgcgacaggctcctggcaaaggcctggaatgggtgtcctacatctccccctctggcggccacaccatctacgccgactccgtgaagggccggtttaccatctcccgggacaactccaagaacaccctgtacctgcagatgaactccctgcgggccgaggacaccgccgtgtactactgtgcccgggtggcccagggaatcgccgccagatcccggacctcctctgtggatcagtggggccagggcaccctggtgacagtgtcctct

SEQ ID NO: 2438 - DNA, 366 bp, Artificial Sequence
  Description of Artificial Sequence: Synthetic polynucleotide
gaggtgcaattgctggaatccggcggaggactggtgcagcctggcggctccctgagactgtcttgcgccgcctccggcttcaccttctcccactacatcatgatgtgggtgcgacaggctcctggcaaggggctggaatgggtgtccggcatctactcctccggcggcatcaccgtgtacgccgactccgtgaagggccggttcaccatctctcgggacaactccaagaacaccctgtacctgcagatgaactccctgcgggccgaggacaccgccgtgtactactgcgcctaccggcggatcggcgtgcccagacgggacgagttcgacatctgggggcagggcaccatggtgacagtgtcctcc

SEQ ID NO: 2439 - DNA, 366 bp, Artificial Sequence
  Description of Artificial Sequence: Synthetic polynucleotide
gaggtgcaattgctggaatccggcggaggactggtgcagcctggcggctccctgagactgtcttgcgccgcctccggcttcaccttctctcactacattatgatgtgggtgcgacaggctcctggcaaaggcctggaatgggtgtccggcatctactcctccggcggcatcaccgtgtacgccgactccgtgaagggccggttcaccatctcccgggacaactccaagaacaccctgtacctgcagatgaactccctgcgggccgaggacaccgccgtgtactactgcgcctacagacggaccggcgtgcccagacgggacgagttcgatatctgggggcagggcaccatggtgacagtgtcctcc

SEQ ID NO: 2440 - DNA, 375 bp, Artificial Sequence
  Description of Artificial Sequence: Synthetic polynucleotide
gaggtgcaattgctggaatccggcggaggactggtgcagcctggcggctccctgagactgtcttgcgccgcctccggcttcaccttctcccactacctgatgacctgggtgcgacaggctcctggcaaaggcctggaatgggtgtcctacatctccccctctggcggccacaccatctacgccgactccgtgaagggccggtttaccatctcccgggacaactccaagaacaccctgtacctgcagatgaactccctgcgggccgaggacaccgccgtgtactactgtgcccgggtggcccagggaatctccgccagatcccggacctcctacttcgattactggggccagggcaccctggtgacagtgtcctct

SEQ ID NO: 2441 - DNA, 375 bp, Artificial Sequence
  Description of Artificial Sequence: Synthetic polynucleotide
gaagttcaattgttagagtctggtggcggtcttgttcagcctggtggttctttacgtctttcttgcgctgcttccggattcactttctctttttactatatggtttgggttcgccaagctcctggtaaaggtttggagtgggtttctgttatctatccttctggtggcattactgtttatgctgactccgttaaaggtcgcttcactatctctagagacaactctaagaatactctctacttgcagatgaacagcttaagggctgaggacacggccgtgtattactgtgcgagagataaatgggcggtgatgcccccctactactactacgctatggacgtctggggccaagggaccacggtcaccgtctcaagc

SEQ ID NO: 2442 - DNA, 384 bp, Artificial Sequence
  Description of Artificial Sequence: Synthetic polynucleotide
gaagttcaattgttagagtctggtggcggtcttgttcagcctggtggttctttacgtctttcttgcgctgcttccggattcactttctcttattaccatatgtcttgggttcgccaagctcctggtaaaggtttggagtgggtttctgttatctctccttctggtggctctactaagtatgctgactccgttaaaggtcgcttcactatctctagagacaactctaagaatactctctacttgcagatgaacagcttaagggctgaggacactgcagtctactattgtgcgagaggcggttcgagcgattacgcttgggggagttatcgtcgaccctactactttgactactggggccagggaaccctggtcaccgtctcaagc

SEQ ID NO: 2443 - DNA, 10 bp, Artificial Sequence
  Description of Artificial Sequence: Synthetic oligonucleotide
  modified_base (4)..(7): a, c, t, g, unknown or other
gatnnnnatc

SEQ ID NO: 2444 - DNA, 15 bp, Artificial Sequence
  Description of Artificial Sequence: Synthetic oligonucleotide
  modified_base (1)..(9): a, c, t, g, unknown or other
nnnnnnnnngcaggt

SEQ ID NO: 2445 - DNA, 11 bp, Artificial Sequence
  Description of Artificial Sequence: Synthetic oligonucleotide
  modified_base (4)..(8): a, c, t, g, unknown or other
gcannnnntgc

SEQ ID NO: 2446 - DNA, 10 bp, Artificial Sequence
  Description of Artificial Sequence: Synthetic oligonucleotide
  modified_base (4)..(7): a, c, t, g, unknown or other
gacnnnngtc

SEQ ID NO: 2447 - DNA, 15 bp, Artificial Sequence
  Description of Artificial Sequence: Synthetic oligonucleotide
  modified_base (4)..(12): a, c, t, g, unknown or other
ccannnnnnnnntgg

SEQ ID NO: 2448 - DNA, 10 bp, Artificial Sequence
  Description of Artificial Sequence: Synthetic oligonucleotide
  modified_base (7)..(10): a, c, t, g, unknown or other
ctcttcnnnn

SEQ ID NO: 2449 - DNA, 12 bp, Artificial Sequence
  Description of Artificial Sequence: Synthetic oligonucleotide
  modified_base (1)..(7): a, c, t, g, unknown or other
nnnnnnngcggg

SEQ ID NO: 2450 - DNA, 12 bp, Artificial Sequence
  Description of Artificial Sequence: Synthetic oligonucleotide
  modified_base (7)..(12): a, c, t, g, unknown or other
gtatccnnnnnn

SEQ ID NO: 2451 - DNA, 12 bp, Artificial Sequence
  Description of Artificial Sequence: Synthetic oligonucleotide
  modified_base (4)..(9): a, c, t, g, unknown or other
gcannnnnntcg

SEQ ID NO: 2452 - DNA, 11 bp, Artificial Sequence
  Description of Artificial Sequence: Synthetic oligonucleotide
  modified_base (4)..(8): a, c, t, g, unknown or other
gccnnnnnggc

SEQ ID NO: 2453 - DNA, 11 bp, Artificial Sequence
  Description of Artificial Sequence: Synthetic oligonucleotide
  modified_base (7)..(11): a, c, t, g, unknown or other
ggtctcnnnnn

SEQ ID NO: 2454 - DNA, 11 bp, Artificial Sequence
  Description of Artificial Sequence: Synthetic oligonucleotide
  modified_base (1)..(5): a, c, t, g, unknown or other
nnnnngagacc

SEQ ID NO: 2455 - DNA, 11 bp, Artificial Sequence
  Description of Artificial Sequence: Synthetic oligonucleotide
  modified_base (4)..(8): a, c, t, g, unknown or other
gacnnnnngtc

SEQ ID NO: 2456 - DNA, 11 bp, Artificial Sequence
  Description of Artificial Sequence: Synthetic oligonucleotide
  modified_base (4)..(8): a, c, t, g, unknown or other
gacnnnnngtc

SEQ ID NO: 2457 - DNA, 12 bp, Artificial Sequence
  Description of Artificial Sequence: Synthetic oligonucleotide
  modified_base (4)..(9): a, c, t, g, unknown or other
gacnnnnnngtc

SEQ ID NO: 2458 - DNA, 11 bp, Artificial Sequence
  Description of Artificial Sequence: Synthetic oligonucleotide
  modified_base (4)..(8): a, c, t, g, unknown or other
ccannnnntgg

SEQ ID NO: 2459 - DNA, 20 bp, Artificial Sequence
  Description of Artificial Sequence: Synthetic oligonucleotide
  modified_base (1)..(15): a, c, t, g, unknown or other
nnnnnnnnnnnnnnngtccc

SEQ ID NO: 2460 - DNA, 17 bp, Artificial Sequence
  Description of Artificial Sequence: Synthetic oligonucleotide
  modified_base (6)..(17): a, c, t, g, unknown or other
gggacnnnnnnnnnnnn

SEQ ID NO: 2461 - DNA, 11 bp, Artificial Sequence
  Description of Artificial Sequence: Synthetic oligonucleotide
  modified_base (7)..(11): a, c, t, g, unknown or other
cgtctcnnnnn

SEQ ID NO: 2462 - DNA, 12 bp, Artificial Sequence
  Description of Artificial Sequence: Synthetic oligonucleotide
  modified_base (1)..(6): a, c, t, g, unknown or other
nnnnnngagacg

SEQ ID NO: 2463 - DNA, 16 bp, Artificial Sequence
  Description of Artificial Sequence: Synthetic oligonucleotide
  modified_base (1)..(10): a, c, t, g, unknown or other
nnnnnnnnnnctcctc

SEQ ID NO: 2464 - DNA, 11 bp, Artificial Sequence
  Description of Artificial Sequence: Synthetic oligonucleotide
  modified_base (4)..(8): a, c, t, g, unknown or other
cctnnnnnagg

SEQ ID NO: 2465 - DNA, 13 bp, Artificial Sequence
  Description of Artificial Sequence: Synthetic oligonucleotide
  modified_base (5)..(9): a, c, t, g, unknown or other
ggccnnnnnggcc

SEQ ID NO: 2466 - DNA, 12 bp, Artificial Sequence
  Description of Artificial Sequence: Synthetic oligonucleotide
  modified_base (4)..(9): a, c, t, g, unknown or other
ccannnnnntgg

SEQ ID NO: 2467 - DNA, 2268 bp, Artificial Sequence
  Description of Artificial Sequence: Synthetic polynucleotide
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcccgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcatacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttggagccttttttttggagattttcaac

SEQ ID NO: 2468 - protein, 108 aa, Artificial Sequence; identical to SEQ ID NO: 275
  Description of Artificial Sequence: Synthetic polypeptide

SEQ ID NO: 2469 - DNA, 1380 bp, Artificial Sequence
  Description of Artificial Sequence: Synthetic polynucleotide
  CDS (1)..(1338)
atgaaaaaattattattcgcaattcctttagttgttcctttctattctcacagtgcacaagacatccagatgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgtggtaccgcttctactgccaccactggtcctgctcctactgaatcccctgctccgggtccttctggtgctcctggctctactggtcctggtgagccgagtcctagtgaagccaccactcctgctcctggtactccgtctcctacttccggccctgagggtgctaccggtgaaggtgctgccggcgagcctccgccttctggtactggtcctgctgctgcttctcctggtggcccgcctggtgaaactgccagtggtcctgctagtactggtggcaccggttctactgctactcctacttcctctgctgagtctccggccggtactgaacctagtagtggtcctgaggaaccttctgaggaaccggctactgaggctgctggcggtactactaccgaagcctccggtactactggtacttctgagaccgcttctcctgaagaggaagctcctagtgctagtgccactcctggcgagactggtactccggaacctggtgctcctggtactcctccgactggcgctggttcttccgagcctgctggttctggtggctctggtagtactcctgccagtgaggcttcttcctctcctgcttctactgctggtagtagtaccgccggtgaggaaccgcctccttaataaggcgcgcctaaccatctatttcaaggaacagtctta

SEQ ID NO: 2470 - protein, 446 aa, Artificial Sequence [sequence omitted]

SEQ ID NO: 2471 - protein, 142 aa, Artificial Sequence; identical to SEQ ID NO: 276
  Description of Artificial Sequence: Synthetic polypeptide

SEQ ID NO: 2472 - DNA, 2284 bp, Artificial Sequence
  Description of Artificial Sequence: Synthetic polynucleotide
  CDS (1)..(1386)
atgaaaaagcttttattcatgatcccgttagttgtaccgttcgtggcccagccggccatggccgaagttcaattgttagagtctggtggcggtcttgttcagcctggtggttctttacgtctttcttgcgctgcttccggattcactttctctcattaccttatgacttgggttcgccaagctcctggtaaaggtttggagtgggtttcttatatctctccttctggtggccatactatttatgctgactccgttaaaggtcgcttcactatctctagagacaactctaagaatactctctacttgcagatgaacagcttaagggctgaggacacggccgtgtattactgtgcgagagtggcccgggggatagcagctcgatcgcgaaccagctactttgactactggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtctagcggactctactccctcagcagcgtagtgaccgtgccctcttctagcttgggcacccagacctacatctgcaacgtgaatcacaagcccagcaacaccaaggtggacaagaaagttgagcccaaatcttgtgcggccgcttctcctgctactgcttccgcttctactgccccggctactgctacccctgagtctgctgaaggcgccactactgagactcctaccactgaaactcctgctgagagtgctagtggtccgcctgctccttctgaatccgccactgaggaatctggtgaggcttctaccagtagtactgctgaagagggtcctgctgaaccgggctctcctgcccctactcctgctgctactccggctgagacctcctctgaacctcctgaggaacctggtggtgccggtactccggctggcactactaccggtgctgagactgaatctgctactgagggtggtgccagtagtgctcctgcttctcctactggcggtgctccttcctctggtgaaaccactactgagggtggcccggccggtcctgctcctgctactgctgcccctaccggtggtggcgctggtggtgaaggttctgctggcggtggtactggtgaggaaggcggtggtggtgctccggagggcagtggtggtggtcctgaaggccctactcctgccactgaggctagtccggaaggtgctcctcctggttctacctccacttctggtcctggcgaggctgcctctccgactagtagtcctggttaatgataaaacgcgtgatgagaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcagtctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 2473 - protein, 462 aa, Artificial Sequence [sequence omitted]

SEQ ID NO: 2474 - DNA, 5932 bp, Artificial Sequence
  Description of Artificial Sequence: Synthetic polynucleotide
gacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcccgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcatacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagctttggagccttttttttggagattttcaacatgaaaaaattattattcgcaattcctttagttgttcctttctattctcacagtgcacaagacatccagatgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctctcactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagttcaccggtgacaaagagcttcaacaggggagagtgtggtaccgcttctactgccaccactggtcctgctcctactgaatcccctgctccgggtccttctggtgctcctggctctactggtcctggtgagccgagtcctagtgaagccaccactcctgctcctggtactccgtctcctacttccggccctgagggtgctaccggtgaaggtgctgccggcgagcctccgccttctggtactggtcctgctgctgcttctcctggtggcccgcctggtgaaactgccagtggtcctgctagtactggtggcaccggttctactgctactcctacttcctctgctgagtctccggccggtactgaacctagtagtggtcctgaggaaccttctgaggaaccggctactgaggctgctggcggtactactaccgaagcctccggtactactggtacttctgagaccgcttctcctgaagaggaagctcctagtgctagtgccactcctggcgagactggtactccggaacctggtgctcctggtactcctccgactggcgctggttcttccgagcctgctggttctggtggctctggtagtactcctgccagtgaggcttcttcctctcctgcttctactgctggtagtagtaccgccggtgaggaaccgcctccttaataaggcgcgcctaaccatctatttcaaggaacagtcttaatgaaaaagcttttattcatgatcccgttagttgtaccgttcgtggcccagccggccatggccgaagttcaattgttagagtctggtggcggtcttgttcagcctggtggttctttacgtctttcttgcgctgcttccggattcactttctctcattaccttatgacttgggttcgccaagctcctggtaaaggtttggagtgggtttcttatatctctccttctggtggccatactatttatgctgactccgttaaaggtcgcttcactatctctagagacaactctaagaatactctctacttgcagatgaacagcttaagggctgaggacacggccgtgtattactgtgcgagagtggcccgggggatagcagctcgatcgcgaaccagctactttgactactggggccagggaaccctggtcaccgtctcaagcgcctccaccaagggcccatcggtcttcccgctagcaccctcctccaagagcacctctgggggcacagcggccctgggctgcctggtcaaggactacttccccgaaccggtgacggtgtcgtggaactcaggcgccctgaccagcggcgtccacaccttcccggctgtcctacagtctagcggactctactccctcagcagcgtagtgaccgtgccctcttctagcttgggcacccagacctacatctgcaacgtgaatcacaagcccagcaacaccaaggtggacaagaaagttgagcccaaatcttgtgcggccgcttctcctgctactgcttccgcttctactgccccggctactgctacccctgagtctgctgaaggcgccactactgagactcctaccactgaaactcctgctgagagtgctagtggtccgcctgctccttctgaatccgccactgaggaatctggtgaggcttctaccagtagtactgctgaagagggtcctgctgaaccgggctctcctgcccctactcctgctgctactccggctgagacctcctctgaacctcctgaggaacctggtggtgccggtactccggctggcactactaccggtgctgagactgaatctgctactgagggtggtgccagtagtgctcctgcttctcctactggcggtgctccttcctctggtgaaaccactactgagggtggcccggccggtcctgctcctgctactgctgcccctaccggtggtggcgctggtggtgaaggttctgctggcggtggtactggtgaggaaggcggtggtggtgctccggagggcagtggtggtggtcctgaaggccctactcctgccactgaggctagtccggaaggtgctcctcctggttctacctccacttctggtcctggcgaggctgcctctccgactagtagtcctggttaatgataaaacgcgtgatgagaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccttagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaactctatctcgggctattcttttgatttataagggattttgccgatttcggtctattggttaaaaaatgagctgatttaacaaaaatttaacgcgaattttaacaaaatattaacgtttacaattttatggtgcagtctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcga

SEQ ID NO: 2475 - protein, 37 aa, Homo sapiens
GPGGGGGPGGGGGPGGGGPGGGGGGGPGGGGGGPGGG

SEQ ID NO: 2476 - protein, 33 aa, Homo sapiens
GAGGGGGGGGGGGGGSGGGGGGGGAGAGGAGAG

SEQ ID NO: 2477 - protein, 32 aa, Homo sapiens
GGGSGSGGAGGGSGGGSGSGGGGGGAGGGGGG

SEQ ID NO: 2478 - protein, 27 aa, Homo sapiens
GDGGGAGGGGGGGGSGGGGSGGGGGGG

SEQ ID NO: 2479 - protein, 25 aa, Homo sapiens
GSGSGSGGGGGGGGGGGGSGGGGGG

SEQ ID NO: 2480 - protein, 23 aa, Homo sapiens
GGGRGGRGGGRGGGGRGGGRGGG

SEQ ID NO: 2481 - protein, 33 aa, Homo sapiens; identical to SEQ ID NO: 2476

SEQ ID NO: 2482 - protein, 32 aa, Homo sapiens; identical to SEQ ID NO: 2477

SEQ ID NO: 2483 - protein, 27 aa, Homo sapiens
GDGGGAGGGGGGGGSGGGGSGGGGGGG

SEQ ID NO: 2484 - protein, 21 aa, Homo sapiens
GSGGSGGSGGGPGPGPGGGGG

SEQ ID NO: 2485 - protein, 18 aa, Homo sapiens
GEGGGGGGEGGGAGGGSG

SEQ ID NO: 2486 - protein, 12 aa, Homo sapiens
GGGGGGGGDGGG

SEQ ID NO: 2487 - protein, 46 aa, Homo sapiens
GGGSGSGGAGGGSGGGSGSGGGGGGAGGGGGGSSGGGSGTAGGHSG

SEQ ID NO: 2488 - protein, 37 aa, Homo sapiens; identical to SEQ ID NO: 2475

SEQ ID NO: 2489 - protein, 35 aa, Homo sapiens
GGSGAGGGGGGGGGGGSGSGGGGSTGGGGGTAGGG

SEQ ID NO: 2490 - protein, 33 aa, Homo sapiens; identical to SEQ ID NO: 2476

SEQ ID NO: 2491 - protein, 33 aa, Homo sapiens; identical to SEQ ID NO: 2476

SEQ ID NO: 2492 - protein, 33 aa, Homo sapiens; identical to SEQ ID NO: 2476

SEQ ID NO: 2493 - protein, 32 aa, Homo sapiens
GHPGSGSGSGGGGGGGGGGGGSGGGGGGAPGG

SEQ ID NO: 2494 - protein, 31 aa, Homo sapiens
GGGGSGGGGGGGGGGGGGGSGSTGGGGSGAG

SEQ ID NO: 2495 - protein, 31 aa, Homo sapiens
GGRGRGGRGRGSRGRGGGGTRGRGRGRGGRG

SEQ ID NO: 2496 - protein, 30 aa, Homo sapiens
GSGGSGGSGGGPGPGPGGGGGPSGSGSGPG

SEQ ID NO: 2497 - protein, 29 aa, Homo sapiens
GGGGGGGGGGGRGGGGRGGGRGGGGEGGG

SEQ ID NO: 2498 - protein, 28 aa, Homo sapiens
GGGGTGSSGGSGSGGGGSGGGGGGGSSG

SEQ ID NO: 2499 - protein, 27 aa, Homo sapiens
GDGGGAGGGGGGGGSGGGGSGGGGGGG

SEQ ID NO: 2500 - protein, 27 aa, Homo sapiens
GGGGGGGSGGGGGSGGGGSGGGRGAGG

SEQ ID NO: 2501 - protein, 27 aa, Homo sapiens
GGGAAGAGGGGSGAGGGSGGSGGRGTG

SEQ ID NO: 2502 - protein, 27 aa, Homo sapiens
GAGGGRGGGAGGEGGASGAEGGGGAGG

SEQ ID NO: 2503 - protein, 27 aa, Homo sapiens
GDGGGAGGGGGGGGSGGGGSGGGGGGG

SEQ ID NO: 2504 - protein, 26 aa, Homo sapiens
GGGGGGGGGGGGGGGGGGGGGGGEAG

SEQ ID NO: 2505 - protein, 26 aa, Homo sapiens
GGGGGGSAGGGSSGGGPGGGGGGAGG

SEQ ID NO: 2506 - protein, 25 aa, Homo sapiens
GGGGGPGGGGGGGPGGGGGPGGGGG

SEQ ID NO: 2507 - protein, 25 aa, Homo sapiens
GRGGAGSGGAGSGAAGGTGSSGGGG

SEQ ID NO: 2508 - protein, 25 aa, Homo sapiens
GGGGGGGGGGGSGGSGGGGGGGGGG

SEQ ID NO: 2509 - protein, 25 aa, Homo sapiens
GGSGGGRGGASGPGSGSGGPGGPAG

SEQ ID NO: 2510 - protein, 25 aa, Homo sapiens
GGHHGDRGGGRGGRGGRGGRGGRAG

SEQ ID NO: 2511 - protein, 25 aa, Homo sapiens
GSRGGGGGGGGGGGGGGGGAGAGGG

SEQ ID NO: 2512 - protein, 24 aa, Homo sapiens
GGRGGRGPGEPGGRGRAGGAEGRG

SEQ ID NO: 2513 - protein, 24 aa, Homo sapiens
GGGGGDAGGSGDAGGAGGRAGRAG

SEQ ID NO: 2514 - protein, 23 aa, Homo sapiens
GGGRGGRGGGRGGGGRGGGRGGG

SEQ ID NO: 2515 - protein, 23 aa, Homo sapiens
GGSGGGGGGSSGGRGSGGGSSGG

SEQ ID NO: 2516 - protein, 23 aa, Homo sapiens
GSGPGTGGGGSGSGGGGGGSGGG

SEQ ID NO: 2517 - protein, 23 aa, Homo sapiens
GARGGGSGGGGGGGGGGGGGGPG

SEQ ID NO: 2518 - protein, 23 aa, Homo sapiens
GGGGGGGGGGGGGGGGGGGGGDG

SEQ ID NO: 2519 - protein, 23 aa, Homo sapiens
GGTRGGTRGGTRGGDRGRGRGAG

SEQ ID NO: 2520 - protein, 23 aa, Homo sapiens
GGTRGGTRGGTRGGDRGRGRGAG

SEQ ID NO: 2521 - protein, 23 aa, Homo sapiens
GAGGGGGGGGGGGGGGAGGGGGG

SEQ ID NO: 2522 - protein, 23 aa, Homo sapiens
GGGRGGRGGGRGGGGRGGGRGGG

SEQ ID NO: 2523 - protein, 22 aa, Homo sapiens
GRGRGGGGGGGGGGGGGRGGGG

SEQ ID NO: 2524 - protein, 22 aa, Homo sapiens
GRGRGRGRGRGRGRGRGRGGAG

SEQ ID NO: 2525 - protein, 22 aa, Homo sapiens
GAGGGGGGGGGGGGGGGGGGGG

SEQ ID NO: 2526 - protein, 22 aa, Homo sapiens
GGGSGGGHSGGSGGGHSGGSGG

SEQ ID NO: 2527 - protein, 22 aa, Homo sapiens
GAGAGGGGGGGGAGGGGSAGSG

SEQ ID NO: 2528 - protein, 22 aa, Homo sapiens
GGPGTGSGGGGAGTGGGAGGPG

SEQ ID NO: 2529 - protein, 22 aa, Homo sapiens
GGGGGGGGGAGGAGGAGSAGGG

SEQ ID NO: 2530 - protein, 21 aa, Homo sapiens
GGDGGGSAGGGAGGGSGGGAG

SEQ ID NO: 2531 - protein, 21 aa, Homo sapiens
GGGGGGSGGGGGGGGGGGGGG

SEQ ID NO: 2532 - protein, 21 aa, Homo sapiens
GPGAGAGSGAGGSSGGGGGPG

SEQ ID NO: 2533 - protein, 21 aa, Homo sapiens
GGGGGGGGGGGSSGGGGSSGG

SEQ ID NO: 2534 - protein, 21 aa, Homo sapiens
GSGSGPGPGSGPGSGPGHGSG

SEQ ID NO: 2535 - protein, 21 aa, Homo sapiens
GPGPGPGPGPGPGPGPGPGPG

SEQ ID NO: 2536 - protein, 21 aa, Homo sapiens
GAGSGGGGAAGAGAGSAGGGG

SEQ ID NO: 2537 - protein, 21 aa, Homo sapiens
GAGSGGGGAAGAGAGSAGGGG

SEQ ID NO: 2538 - protein, 21 aa, Homo sapiens
GGGGGGGSGGGGGGSGGGGGG

SEQ ID NO: 2539 - protein, 21 aa, Homo sapiens
GRGRGRGRGRGRGRGRGRGRG

SEQ ID NO: 2540 - protein, 21 aa, Homo sapiens
GGGGGGGSGGSGGGGGSGGGG

SEQ ID NO: 2541 - protein, 21 aa, Homo sapiens
GGEEGGASGGGPGAGSGSAGG

SEQ ID NO: 2542 - protein, 21 aa, Homo sapiens
GSGSGPGPGSGPGSGPGHGSG

SEQ ID NO: 2543 - protein, 21 aa, Homo sapiens
GRGRGRGRGRGRGRGRGRGRG

SEQ ID NO: 2544 - protein, 21 aa, Homo sapiens
GGGGGGGGDGGGRRGRGRGRG

SEQ ID NO: 2545 - protein, 20 aa, Homo sapiens
GGPGGPGGGGAGGPGGAGAG

SEQ ID NO: 2546 - protein, 20 aa, Homo sapiens
GTGGGGSTGGGGGGGGSGHG

SEQ ID NO: 2547 - protein, 20 aa, Homo sapiens
GPAGAGGGGGGGGGGGGGGG

SEQ ID NO: 2548 - protein, 20 aa, Homo sapiens
GGTGGSSGSSGSGSGGGRRG

SEQ ID NO: 2549 - protein, 20 aa, Homo sapiens
GGTGGSSGSSGSGSGGGRRG

SEQ ID NO: 2550 - protein, 20 aa, Homo sapiens
GSGTGTTGSSGAGGPGTPGG

SEQ ID NO: 2551 - protein, 20 aa, Homo sapiens
GGSGGGAAGGGAGGAGAGAG

SEQ ID NO: 2552 - protein, 20 aa, Homo sapiens
GGSGGGAAGGGAGGAGAGAG

SEQ ID NO: 2553 - protein, 20 aa, Homo sapiens
GSSGGGGGGAGAAGGAGGAG

SEQ ID NO: 2554 - protein, 20 aa, Homo sapiens
GPGPSGGPGGGGGGGGGGGG

SEQ ID NO: 2555 - protein, 20 aa, Homo sapiens
GGGGGGGGGGGGGGAAGAGG

SEQ ID NO: 2556 - protein, 20 aa, Homo sapiens
GRGRGRGRGRGRGRGRGRGG

SEQ ID NO: 2557 - protein, 20 aa, Homo sapiens
GSAGGSSGAAGAAGGGAGAG

SEQ ID NO: 2558 - DNA, 327 bp, Artificial Sequence
  Description of Artificial Sequence: Synthetic polynucleotide
caagacatccagatgacccagtctccaggcaccctgtctttgtctccaggggaaagagccaccctctcctgcaggaccagtcaatttgttaacagcaactacttagcctggtaccaacagacacctggccaggctcccaggctcctcatctatggtgcatccagcagggccactggcatcccagacaggttcagtggcactgggtatgggacagacttcactctcaccatcagcagactggagcctgaagattatggaacttactactgtcagcagagttccagaaccccgtggacgttcggccaagggaccagagtggaaatcaaa

SEQ ID NO: 2559 - DNA, 324 bp, Artificial Sequence; identical to SEQ ID NO: 2418
  Description of Artificial Sequence: Synthetic polynucleotide

SEQ ID NO: 2560 - protein, 109 aa, Artificial Sequence; identical to SEQ ID NO: 1142
  Description of Artificial Sequence: Synthetic polypeptide

SEQ ID NO: 2561 - protein, 108 aa, Artificial Sequence; identical to SEQ ID NO: 2388
  Description of Artificial Sequence: Synthetic polypeptide

SEQ ID NO: 2562 - DNA, 375 bp, Artificial Sequence; identical to SEQ ID NO: 2432
  Description of Artificial Sequence: Synthetic polynucleotide

SEQ ID NO: 2563 - DNA, 375 bp, Artificial Sequence
  Description of Artificial Sequence: Synthetic polynucleotide
gaagttcaattgttagagtctggtggcggtcttgttcagcctggtggttctttacgtctttcttgcgctgcttccggattcactttctctcattaccttatgacttgggttcgccaagctcctggtaaaggtttggagtgggtttcttatatctctccttctggtggccatactatttatgctgactccgttaaaggtcgcttcactatctctagagacaactctaagaatactctctacttgcagatgaacagcttaagggctgaggacacggccgtgtattactgtgcgagagtggcccgggggatagcagctcgatcgcgaaccagctactttgactactggggccagggaaccctggtcaccgtctcaagc

SEQ ID NO: 2564 - protein, 125 aa, Artificial Sequence; identical to SEQ ID NO: 2403
  Description of Artificial Sequence: Synthetic polypeptide

SEQ ID NO: 2565 - protein, 125 aa, Artificial Sequence; identical to SEQ ID NO: 2403
  Description of Artificial Sequence: Synthetic polypeptide

SEQ ID NO: 2566 - protein, 19 aa, Artificial Sequence
  Description of Artificial Sequence: Synthetic peptide
LVTNEECQKRYQDYKITQQ

SEQ ID NO: 2567 - protein, 5 aa, Artificial Sequence
  Description of Artificial Sequence: Synthetic peptide
SWGDI

SEQ ID NO: 2568 - protein, 8 aa, Artificial Sequence
  Description of Artificial Sequence: Synthetic peptide
HDIALIKL

SEQ ID NO: 2569 - protein, 14 aa, Artificial Sequence
  Description of Artificial Sequence: Synthetic peptide
WVTGWGFSKEKGEI

SEQ ID NO: 2570 - protein, 15 aa, Artificial Sequence
  Description of Artificial Sequence: Synthetic peptide
TPFSQIKEIIIHQNY

SEQ ID NO: 2571 - protein, 10 aa, Artificial Sequence
  Description of Artificial Sequence: Synthetic peptide
ACKGDSGGPL

SEQ ID NO: 2572 - protein, 16 aa, Artificial Sequence
  Description of Artificial Sequence: Synthetic peptide
AHCFDGLPLQDVWRIY

SEQ ID NO: 2573 - protein, 638 aa, Homo sapiens [sequence omitted]

SEQ ID NO: 2574 - protein, 636 aa, Bos taurus
MIALRQAAYFICLFATVSCGCLTQLYHNIFFRGGDVSAMYTPDAQYCQLMCTFHPRCLLFSFLPENSTSDADKRFGCFLKDSVTGTLPRVSRTGAISGHSLKRCGHQISACHRSIYKGIDMRGVNFNASKVRSAKECQERCTNNIHCQFFTYATKTFFSAEYRNTCLLKRSPQGTPTRIKVLSDVESGFSLKACGNSKIGCRVDIFQHSAFSDVDVAGIIAPDAFVCRTICTYHPSCLFFTFYTNAWKTDSQRNVCFLKTSQSGSPSSPTPQENAISGYSLLTCKQTLPGTEPCHSKIYPQVAFEGEELHVTFVKGVDGCQETCTKMIRCQFFTYSLFPEDCRGEKCKCSLRLSLDGSPTNITYGTQASSGYSLRLCKRGDSRVCTTKRTRIVGGTNASWGEWPWQVSLQVKQRAQSHLCGGSIIGRQWVLTAAHCFDGLLLSNIWRIYGGILNLSEITTETSFSQIKEIIVHPNYKISEGSHDIALIKLEAPLNFTDLQKAICLPSKDDTKPVYTDCWITGWGFTEEKGKIQNTLQKANIPLISNEECQKSYRDYKITKQMICAGYKEGGKDACKGDSGGPLVCQHEETWHLVGITSWGEGCARREQPGVYTKVAEYVDWILEKTQDSHGQPLRK

SEQ ID NO: 2575 - protein, 638 aa, Mus musculus; identical to SEQ ID NO: 4

SEQ ID NO: 2576 - protein, 638 aa, Rattus norvegicus
MILFKQVGYFVSLFATVSCGCLSQLYANTFFRGGDLAAIYTPDAQHCQKMCTFHPRCLLFSFLAVSPTKETDKRFGCFMKESITGTLPRIHRTGAISGHSLKQCGHQLSACHQDIYEGLDMRGSNFNISKTDSIEECQKLCTNNIHCQFFTYATKAFHRPEYRKSCLLKRSSSGTPTSIKPVDNLVSGFSLKSCALSEIGCPMDIFQHFAFADLNVSQVVTPDAFVCRTVCTFHPNCLFFTFYTNEWETESQRNVCFLKTSKSGRPSPPIIQENAVSGYSLFTCRKARPEPCHFKIYSGVAFEGEELNATFVQGADACQETCTKTIRCQFFTYSLLPQDCKAEGCKCSLRLSTDGSPTRITYEAQGSSGYSLRLCKVVESSDCTTKINARIVGGTNSSLGEWPWQVSLQVKLVSQNHMCGGSIIGRQWILTAAHCFDGIPYPDVWRIYGGILNLSEITNKTPFSSIKELIIHQKYKMSEGSYDIALIKLQTPLNYTEFQKPICLPSKADTNTIYTNCWVTGWGYTKERGETQNILQKATIPLVPNEECQKKYRDYVITKQMICAGYKEGGIDACKGDSGGPLVCKHSGRWQLVGITSWGEGCARKEQPGVYTKVAEYIDWILEKIQSSKERALETSPA

SEQ ID NO: 2577 - protein, 643 aa, Sus scrofa
MEVIVLFRIISFRQAVYFMCLFAAVSCGCLPQLHKNTFFRGGDVSAMYTPSARHCQMMCTFHPRCLLFSFLPADSTSVTDKRFGCFLKDSVTGMLPRVLRENAISGHSLKQCGHQIRACHRDIYKGIDMRGVNFNVSKVKTVEECQERCTNSIHCLFFTYATQAFNNAEYRNNCLLKHSPGGTPTSIKVLANVESGFSLKPCADSEIGCHMDIFQHLAFSDVDVARVIAPDAFVCRTICTYHPNCLFFTFYTNAWKIESQRNVCFLKTSHSGTPSFPTPQENAISGYSLLTCKQTLPEPCHSKIYSEVDFEGEELNVTFVQGANLCQETCTKTIRCQFFTYSLHPEDCRGEKCKCSLRLSSDGSPTKITHGMRASSGYSLRLCRSGDHSACATKANTRIVGGTDSFLGEWPWQVSLQAKLRAQNHLCGGSIIGHQWVLTAAHCFDGLSLPDIWRIYGGILNISEITKETPFSQVKEIIIHQNYKILESGHDIALLKLETPLNYTDFQKPICLPSRDDTNVVYTNCWVTGWGFTEEKGEIQNILQKVNIPLVSNEECQKSYRDHKISKQMICAGYKEGGKDACKGESGGPLVCKYNGIWHLVGTTSWGEGCARREQPGVYTKVIEYMDWILEKTQDDDGQSWMK

SEQ ID NO: 2578 - protein, 629 aa, Xenopus laevis
MACYYSSLLFLLLFTLVSGGCISELYQDIYWQGGDLRSVFAPDVEYCQLVCTFSPRCLMFSYLPASWPKENERFACYLKESATNMLPKVTLTGVISGHSLKNCKSKINVCRDKNFPGIDMIGTNYNVTSTANVQQCKEGCTNDIYCQYFTYVTQEFHSAQLRNRCYFKYSGKGMPTRIRLLDNVISGFSLKACGKSSLGCQNDLFQNMELPGETLTRVFAPDVLTCQKICTFYPNCLFFTFFKKDSKDPLQRNVCYVRTSTKGIPDEVINKEHTISGFSLLSCKFSPSVCPLTMLSDSEFLGDELLVEEVSGEKECQQACTNNIRCQFFTYGPVKSGCLEKKCKCHMKISSNGLPTGIRHGNGGISGFSLRLCKMKSVKGCGEPSEHANRIVGGTDSVLGEWPWQVSMHLRLGASYKKHACGGSIISNQWIVTAAHCVALYPQPQMWIIYSGFVRILNITKSTPFSELEKIIIHPHYTGAGNGSDIALLKLKTPIVFNDHQKAICLPPSEATLVLPNSCWITGWGYTEETGSPGNVLQKAEVPPISTEECQGSYVETRIDKKVLCAGYKSGKIDACKGDSGGPLVCEVDEIWYLTGITSWGEGCARPGKPGVYTRVSTFTNWILEHTKL

SEQ ID NO: 2579 - protein, 641 aa, Macaca mulatta
MILFKQATYFISLFATVSCGCLTQLYENAFFRGGDVASMYTPNAQHCQMMCTFHPRCLLFSFLPASSINDMEKRFGCFLKDSVTGTLPKVRRAGAISGHSLKQCGHQISACHRDIYKGIDMRGVNFNVSKVSSVEECQKRCTNNIRCQFFSYATQTFHNAEYRNTCLLKHSPGGTPTTIKVLNNVESGFSLKPCALSEIGCHMNIFQHLAFSDVDVARVLAPDAFVCRTICTYHPSCLFFTFYTNAWKIESQRRVCMLAGSQDGAAHSSLGDARLRLKQKNKNKQTKKNTLPEPCHSKIYPGVDFGGEELNVTFVKGVNVCQETCTKMIRCQFFTYSLLPEDCKEEKCKCFLRLSSDGSPTRITYGTQGSSGYSLRLCNTGDSSVCTTKTSSRIVGGTNSSWGEWPWQVSLQVKLMAQRHLCGGSLIGHQWVLTAAHCFDGLPLPDVWRIYSGILNLSDITKETPFSQIKEIIIHQNYRISEGNHDIALIKLQAPLNYTEFQKPICLPSKGDTNTIYTNCWVTGWGFSKEKGEIQDILQKVNIPLVTNEECQKRYQDYKITQRMVCAGYKEGGKDACKGDSGGPLACKHNGMWRLVGITSWGEGCARREQPGVYTKVAEYMDWILEKTQSSDGNARMQAPA

SEQ ID NO: 2580 - protein, 629 aa, Canis lupus familiaris
MLIKLPLKWVSQGCLTQLYKNTFFKGGDLTAMYTPNAHHCQMMCTFHPRCLLFSFLPESSTNDVNKRFGCFLKDSVTETLPRMSWTSAISGHSLKQCGHQISACHRDIHKGIDMRGVNFNVSKVKSVEECQKKCTNSIHCQFFTYATETFYNVEYRNSCLLKNGPGGTPSSIKVLADVVSGFSLKSCALSEIGCHMNIFQHLAFSDVDVARVVTPDAFVCQTICTYHPNCLFFTFYTKAWHLEPQRNVCFLKTSKSGTPSSPTSQKNAMSGYSLLTCKKALPEPCHSKIYSGVDFEGEELNVTFAEGVNACQETCTKMIRCQFFTYSLRPEDCRGEKCKCSLRLSLDGSPTGMTYGTRVSSGYSLRLCKSGDSSVCTTKTSTRIVGGTNSSWGEWPWQVSLQVKLRAQSHLCGGSIIGRQWVLTAAHCFDELSLPDVWRIYSGILNLSEITKETPFSQIKEIIIHQNYKITDGGSYDIALIKLEAPLNYTEFQKPICLPSKDDTNTTYTNCWVTGWGFTKERGEIQNSLQKANIPLVPNEECQKKYRDYEVNKQMICAGYKEGGKDACKGDSGGPLVCKHNGNWHLVGITSWGEGCGRREQPGVYTKVAEYVDWILEKTQVGDGHAGLG

SEQ ID NO: 2581 - protein, 14 aa, Artificial Sequence
  Description of Artificial Sequence: Synthetic peptide
GGLLLWFRELKSNY

We claim:

1. An isolated antibody that binds to the active form of human plasma kallikrein, wherein the antibody comprises:
   a heavy chain variable region comprising a complementary determining region (CDR) 1 set forth as HYIMM (SEQ ID NO: 166), a CDR2 set forth as GIYSSGGITVYADS-VKG (SEQ ID NO: 167), and a CDR3 set forth as RRIGVPRRDEFDI (SEQ ID NO: 1171); and
   a light chain variable region comprising a CDR1 set forth as RASQSISSWLA (SEQ ID NO: 1172), a CDR2 set forth as KASTLES (SEQ ID NO: 1173), and a CDR3 set forth as QQYNTYWT (SEQ ID NO: 1174).

2. The antibody of claim 1, wherein the heavy chain variable region comprises the amino acid sequence of EVQLLESGGGLVQPGGSLRLSCAASG-FTFSHYIMMWVRQAPGKGLEWVSGIYSSGGITVY ADSVKGRFTISRDNSKNTLYLQMNSL-RAEDTAVYYCAYRRIGVPRRDEFDIWGQGTMVTV SS (SEQ ID NO: 2410), and the light chain variable region comprises the amino acid sequence of DIQMTQSPSTLSAS-VGDRVTITCRASQSISSWLAWYQQK-PGKAPKLLIYKASTLESGVPSRF SGSGSGTEFTLTISS-LQPDDFATYYCQQYNTYWTFGQGTKVEIK (SEQ ID NO: 2394).

3. The antibody of claim 1, wherein the heavy chain variable region comprises the amino acid sequence of EVQLLESGGGLVQPGGSLRLSCAASG-FTFSHYIMMWVRQAPGKGLEWVSGIYSSGGITVY ADSVKGRFTISRDNSKNTLYLQMNSL-RAEDTAVYYCAYRRIGVPRRDEFDIWGQGTMVTV SS (SEQ ID NO: 2410), and the light chain variable region comprises the amino acid sequence of DIQMTQSPSTLSAS-VGDRVTITCRASQSISSWLAWYQQK-PGKAPKLLIYKASTLESGVPSRF SGSGSGTEFTLTISS-LQPDDFATYYCQQYNTYWTFGQGTKVEI (SEQ ID NO: 2395).

4. The antibody of claim 1, wherein the antibody is a full-length antibody or an antigen-binding fragment.

5. A pharmaceutical composition comprising the antibody of claim 1 and a pharmaceutically acceptable carrier.

6. The antibody of claim 4, wherein the antibody is an antigen-binding fragment.

7. The antibody of claim 4, wherein the antibody is an IgG molecule.

* * * * *

UNITED STATES PATENT AND TRADEMARK OFFICE
CERTIFICATE OF CORRECTION

| | | |
|---|---|---|
| PATENT NO. | : 8,816,055 B2 | Page 1 of 1 |
| APPLICATION NO. | : 13/345170 | |
| DATED | : August 26, 2014 | |
| INVENTOR(S) | : Sexton et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 80 days.

Signed and Sealed this
Twenty-fifth Day of August, 2015

Michelle K. Lee
*Director of the United States Patent and Trademark Office*